US012790596B2

(12) United States Patent
Abul-Husn et al.

(10) Patent No.: US 12,790,596 B2
(45) **Date of Patent: *Nov. 10, 2026**

(54) HSD17B13 VARIANTS AND USES THEREOF

(71) Applicant: Regeneron Pharmaceuticals, Inc., Tarrytown, NY (US)

(72) Inventors: Noura S. Abul-Husn, New York, NY (US); Omri Gottesman, Rancho Sante Fe, CA (US); Alexander Li, White Plains, NY (US); Xiping Cheng, Northvale, NJ (US); Yurong Xin, Stamford, CT (US); Evangelos Pefanis, Somers, NY (US); Suzanne Hartford, Putnam Valley, NY (US); Jesper Gromada, Concord, MA (US); Frederick E. Dewey, Winchester, MA (US); Aris Baras, Bedford Corners, NY (US); Alan Shuldiner, Baltimore, MD (US)

(73) Assignee: Regeneron Pharmaceuticals, Inc., Tarrytown, NY (US)

( * ) Notice: Subject to any disclaimer, the term of this patent is extended or adjusted under 35 U.S.C. 154(b) by 402 days.

This patent is subject to a terminal disclaimer.

(21) Appl. No.: 17/930,180

(22) Filed: Sep. 7, 2022

(65) Prior Publication Data

US 2023/0031669 A1 Feb. 2, 2023

Related U.S. Application Data

(60) Continuation of application No. 16/942,386, filed on Jul. 29, 2020, now Pat. No. 11,485,958, which is a (Continued)

(51) Int. Cl.

| | |
|---|---|
| ***C12N 9/04*** | (2006.01) |
| ***A61K 31/713*** | (2006.01) |
| ***A61K 38/44*** | (2006.01) |
| ***A61K 38/46*** | (2006.01) |
| ***A61K 47/61*** | (2017.01) |
| ***A61P 1/16*** | (2006.01) |
| ***C12N 9/22*** | (2006.01) |
| ***C12N 9/96*** | (2006.01) |
| ***C12N 15/11*** | (2006.01) |
| ***C12N 15/113*** | (2010.01) |
| ***C12N 15/85*** | (2006.01) |

(Continued)

(52) U.S. Cl.

CPC .......... *C12N 9/0006* (2013.01); *A61K 31/713* (2013.01); *A61K 38/443* (2013.01); *A61K 38/465* (2013.01); *A61K 47/61* (2017.08); *A61P 1/16* (2018.01); *C12N 9/22* (2013.01); *C12N 9/96* (2013.01); *C12N 15/11* (2013.01); *C12N 15/113* (2013.01); *C12N 15/1137* (2013.01); *C12N 15/85* (2013.01); *C12N 15/907* (2013.01); *C12Q 1/32* (2013.01); *C12Q 1/6827* (2013.01); *C12Q 1/6876* (2013.01); *C12Q 1/6883* (2013.01); *C12Y 101/01051* (2013.01); *C12Y 101/01062* (2013.01); *G01N 33/5067* (2013.01); *A61K 48/00* (2013.01); *A61K 48/0066* (2013.01); *C12N 2310/14* (2013.01); *C12N 2310/20* (2017.05); *C12N 2310/531* (2013.01); *C12N 2320/30* (2013.01); *C12N 2320/34* (2013.01); *C12N 2800/24* (2013.01); *C12N 2800/80* (2013.01); *C12Q 2600/118* (2013.01); *C12Q 2600/156* (2013.01); *C12Q 2600/158* (2013.01); *G01N 2333/4704* (2013.01); *G01N 2800/085* (2013.01)

(58) Field of Classification Search

CPC ........... A61K 31/713; A61P 1/16; C12N 9/22; C12N 9/96; C12N 15/11; C12N 15/113; C12N 15/1137; C12N 2310/20

See application file for complete search history.

(56) References Cited

U.S. PATENT DOCUMENTS

| | | | |
|---|---|---|---|
| 6,147,066 | A | 11/2000 | Petit et al. |
| 7,820,380 | B2 | 10/2010 | Huang |

(Continued)

FOREIGN PATENT DOCUMENTS

| | | | |
|---|---|---|---|
| CN | 103520724 | A | 1/2014 |
| CN | 104698108 | A | 6/2015 |

(Continued)

OTHER PUBLICATIONS

Rotman et al. ("Identification ofHSD17B13andRORAas Genes Involved in Pathogenesis of Nonalcoholic Fatty Liver Disease: 145." Hepatology 56 (2012): 265A).*

(Continued)

*Primary Examiner* — Kimberly Chong
(74) *Attorney, Agent, or Firm* — Alston & Bird LLP

(57) ABSTRACT

Provided are compositions related to HSD17B13 variants, including isolated nucleic acids and proteins related to variants of HSD17B13, and cells comprising those nucleic acids and proteins. Also provided are methods related to HSD17B13 variants. Such methods include methods for modifying a cell through use of any combination of nuclease agents, exogenous donor sequences, transcriptional activators, transcriptional repressors, and expression vectors for expressing a recombinant HSD17B13 gene or a nucleic acid encoding an HSD17B13 protein. Also provided are therapeutic and prophylactic methods for treating a subject having or at risk of developing chronic liver disease.

20 Claims, 20 Drawing Sheets

Specification includes a Sequence Listing.

Related U.S. Application Data division of application No. 15/875,514, filed on Jan. 19, 2018, now Pat. No. 10,787,647.

(60) Provisional application No. 62/581,918, filed on Nov. 6, 2017, provisional application No. 62/472,972, filed on Mar. 17, 2017, provisional application No. 62/449,335, filed on Jan. 23, 2017.

(51) Int. Cl.

| | |
|---|---|
| ***C12N 15/90*** | (2006.01) |
| ***C12Q 1/32*** | (2006.01) |
| ***C12Q 1/6827*** | (2018.01) |
| ***C12Q 1/6876*** | (2018.01) |
| ***C12Q 1/6883*** | (2018.01) |
| ***G01N 33/50*** | (2006.01) |
| *A61K 48/00* | (2006.01) |

(56) References Cited

U.S. PATENT DOCUMENTS

| | | | |
|---|---|---|---|
| 7,951,382 | B2 | 5/2011 | Gelber et al. |
| 7,951,776 | B2 | 5/2011 | Gelber |
| 8,071,302 | B2 | 12/2011 | Huang |
| 8,945,847 | B2 | 2/2015 | Benvenisty et al. |
| 9,051,567 | B2 | 6/2015 | Fitzgerald et al. |
| 9,072,743 | B2 | 7/2015 | Dilly et al. |
| 9,328,346 | B2 | 5/2016 | Lee et al. |
| 9,375,433 | B2 | 6/2016 | Dilly et al. |
| 9,526,720 | B2 | 12/2016 | Nagiec et al. |
| 9,574,241 | B2 | 2/2017 | Ferrando et al. |
| 9,585,887 | B2 | 3/2017 | Dilly et al. |
| 9,585,890 | B2 | 3/2017 | Dilly et al. |
| 9,617,514 | B2 | 4/2017 | Lunuyak |
| 9,629,804 | B2 | 4/2017 | Heartlein et al. |
| 9,632,090 | B2 | 4/2017 | DePinho et al. |
| 9,677,138 | B2 | 6/2017 | Steiling et al. |
| 9,796,762 | B2 | 10/2017 | Kelly et al. |
| 9,808,462 | B2 | 11/2017 | Dilly et al. |
| 9,816,094 | B2 | 11/2017 | Lee et al. |
| 10,052,284 | B2 | 8/2018 | Heartlein et al. |
| 10,577,630 | B2 | 3/2020 | Zhang et al. |
| 10,767,175 | B2 | 9/2020 | Dellinger et al. |
| 10,787,647 | B2 | 9/2020 | Abul-Husn et al. |
| 10,961,583 | B2 | 3/2021 | Xin et al. |
| 11,485,958 | B2 | 11/2022 | Abul-Husn et al. |
| 11,702,700 | B2 | 7/2023 | Xin et al. |
| 11,753,628 | B2 | 9/2023 | Abul-Husn et al. |
| 11,845,963 | B2 | 12/2023 | Abul-Husn et al. |
| 2003/0004102 | A1 | 1/2003 | Ashkenazi et al. |
| 2005/0158376 | A1 | 7/2005 | Sardi et al. |
| 2007/0219169 | A1 | 9/2007 | Becourt et al. |
| 2008/0300170 | A1 | 12/2008 | Gelber et al. |
| 2009/0169585 | A1 | 7/2009 | Sardi |
| 2009/0203602 | A1 | 8/2009 | Gelber et al. |
| 2010/0028879 | A1 | 2/2010 | Labrie et al. |
| 2010/0056384 | A1 | 3/2010 | Lobbs et al. |
| 2010/0209427 | A1 | 8/2010 | Li et al. |
| 2010/0266618 | A1 | 10/2010 | Stojdl et al. |
| 2010/0267052 | A1 | 10/2010 | Gelber et al. |
| 2011/0129831 | A1 | 6/2011 | Cargill et al. |
| 2011/0130442 | A1 | 6/2011 | Kosaka et al. |
| 2011/0262462 | A1 | 10/2011 | Platt et al. |
| 2012/0015904 | A1 | 1/2012 | Sharp et al. |
| 2012/0028816 | A1 | 2/2012 | Warren et al. |
| 2012/0058088 | A1 | 3/2012 | Sardi |
| 2012/0276528 | A1 | 11/2012 | Cargill et al. |
| 2013/0005596 | A1 | 1/2013 | Gong et al. |
| 2013/0029873 | A1 | 1/2013 | de Perrot et al. |
| 2013/0079241 | A1 | 3/2013 | Lou et al. |
| 2013/0237454 | A1 | 9/2013 | Schutzer |
| 2013/0309769 | A1 | 11/2013 | Benvenisty et al. |
| 2014/0004153 | A1 | 1/2014 | Cowing et al. |
| 2014/0011889 | A1 | 1/2014 | Sardi |
| 2014/0045915 | A1 | 2/2014 | Skog et al. |
| 2014/0057800 | A1 | 2/2014 | Bratbakk et al. |
| 2014/0072957 | A1 | 3/2014 | Huang et al. |
| 2014/0088120 | A1 | 3/2014 | Dilly et al. |
| 2014/0163118 | A1 | 6/2014 | Giuliani et al. |
| 2014/0179536 | A1 | 6/2014 | Hobbs et al. |
| 2014/0295425 | A1 | 10/2014 | Nagy |
| 2014/0329704 | A1 | 11/2014 | Melton et al. |
| 2014/0363502 | A1 | 12/2014 | Sardi |
| 2014/0378425 | A1 | 12/2014 | Wilde et al. |
| 2015/0050728 | A1 | 2/2015 | Benvenisty et al. |
| 2015/0079061 | A1 | 3/2015 | Casey et al. |
| 2015/0079062 | A1 | 3/2015 | Casey et al. |
| 2015/0366997 | A1 | 12/2015 | Guild et al. |
| 2016/0024498 | A1 | 1/2016 | Fitzgerald et al. |
| 2016/0030585 | A1 | 2/2016 | Barnes et al. |
| 2016/0032388 | A1 | 2/2016 | Huang et al. |
| 2016/0032395 | A1 | 2/2016 | Davicioni et al. |
| 2016/0145646 | A1 * | 5/2016 | Frendewey .......... C12N 15/102 800/24 |
| 2016/0184458 | A1 | 6/2016 | Heartlein et al. |
| 2016/0237501 | A1 | 8/2016 | Sharp et al. |
| 2016/0320395 | A1 | 11/2016 | Ward et al. |
| 2016/0355806 | A1 | 12/2016 | Lee et al. |
| 2016/0355813 | A1 | 12/2016 | Lee et al. |
| 2016/0376598 | A1 | 12/2016 | Lee et al. |
| 2017/0022504 | A1 | 1/2017 | Lee et al. |
| 2017/0037396 | A1 | 2/2017 | Lee et al. |
| 2017/0044550 | A1 | 2/2017 | Lee et al. |
| 2017/0247758 | A1 | 8/2017 | Spiller et al. |
| 2017/0247759 | A1 | 8/2017 | Wilde et al. |
| 2017/0283770 | A1 | 10/2017 | Lunyak |
| 2017/0335396 | A1 | 11/2017 | Kennedy et al. |
| 2017/0340661 | A1 | 11/2017 | Fitzgerald et al. |
| 2017/0349903 | A1 | 12/2017 | Liu et al. |
| 2017/0356002 | A1 | 12/2017 | Thompson et al. |
| 2018/0179553 | A1 | 6/2018 | Watson et al. |
| 2018/0179593 | A1 | 6/2018 | Melton et al. |
| 2018/0185516 | A1 | 7/2018 | Ansell et al. |
| 2018/0201936 | A1 | 7/2018 | Hinkle |
| 2018/0216084 | A1 | 8/2018 | Abul-Husn et al. |
| 2018/0216104 | A1 | 8/2018 | Abul-Husn et al. |
| 2018/0273955 | A1 | 9/2018 | Fitzgerald et al. |
| 2019/0002869 | A1 | 1/2019 | Yin et al. |
| 2019/0316121 | A1 | 10/2019 | Smith et al. |
| 2019/0365924 | A1 | 12/2019 | Conway et al. |
| 2019/0390195 | A1 | 12/2019 | Tondera et al. |
| 2020/0354693 | A1 | 11/2020 | Abul-Husn et al. |
| 2020/0392541 | A1 | 12/2020 | Zhang et al. |
| 2021/0246508 | A1 | 8/2021 | Xin et al. |
| 2022/0056454 | A1 | 2/2022 | Li et al. |
| 2022/0267743 | A1 | 8/2022 | Abul-Husn et al. |
| 2023/0383353 | A1 | 11/2023 | Xin et al. |
| 2024/0141305 | A1 | 5/2024 | Abul-Husn et al. |

FOREIGN PATENT DOCUMENTS

| | | | |
|---|---|---|---|
| EP | 3011032 | B1 | 10/2019 |
| EP | 3620524 | A1 | 3/2020 |
| EP | 3011031 | B1 | 9/2020 |
| RU | 2545990 | C1 | 4/2015 |
| RU | 2562868 | C2 | 9/2015 |
| WO | WO 1995/029255 | A1 | 11/1995 |
| WO | WO 1997/020942 | A1 | 6/1997 |
| WO | WO 1999/046279 | A2 | 9/1999 |
| WO | WO 2004/110459 | A1 | 12/2004 |
| WO | WO 2005/108415 | A2 | 11/2005 |
| WO | WO 2009/039195 | A1 | 3/2009 |
| WO | WO 2010/028110 | A2 | 3/2010 |
| WO | WO 2010/040571 | A2 | 4/2010 |
| WO | WO 2010/064702 | A1 | 6/2010 |
| WO | WO 2011/084747 | A2 | 7/2011 |
| WO | WO 2012/052953 | A1 | 4/2012 |
| WO | WO 2011/006214 | A1 | 6/2012 |
| WO | WO 2012/087983 | A1 | 6/2012 |
| WO | WO 2013/126565 | A1 | 8/2013 |
| WO | WO 2013/166264 | A2 | 11/2013 |
| WO | WO 2013/176772 | A1 | 11/2013 |
| WO | WO 2013/177060 | A2 | 11/2013 |

(56) References Cited

FOREIGN PATENT DOCUMENTS

| | | | |
|---|---|---|---|
| WO | WO 2013/190075 | A2 | 12/2013 |
| WO | WO 2014/196957 | A1 | 12/2014 |
| WO | WO 2015/169971 | A1 | 11/2015 |
| WO | WO 2016/004387 | A1 | 1/2016 |
| WO | WO 2016/009246 | A1 | 1/2016 |
| WO | WO 2017/048620 | A1 | 3/2017 |
| WO | WO 2017/106210 | A1 | 6/2017 |
| WO | WO 2017/106283 | A1 | 6/2017 |
| WO | WO 2017/106292 | A1 | 6/2017 |
| WO | WO 2017/106364 | A2 | 6/2017 |
| WO | WO 2017/106370 | A1 | 6/2017 |
| WO | WO 2017/106375 | A1 | 6/2017 |
| WO | WO 2017/106382 | A1 | 6/2017 |
| WO | WO 2017/156310 | A1 | 9/2017 |
| WO | WO 2017/191274 | A2 | 11/2017 |
| WO | WO 2017/211947 | A1 | 12/2017 |
| WO | WO 2018/107026 | A1 | 6/2018 |
| WO | WO 2018/107028 | A1 | 6/2018 |
| WO | WO 2018/136702 | A1 | 7/2018 |
| WO | WO 2018/136758 | A1 | 7/2018 |
| WO | WO 2018/220211 | A1 | 12/2018 |
| WO | WO 2019/183164 | A1 | 9/2019 |
| WO | WO 2019/183329 | A1 | 9/2019 |
| WO | WO 2019/237069 | A1 | 12/2019 |
| WO | WO 2019/246203 | A1 | 12/2019 |

OTHER PUBLICATIONS

Zhang et al. (“Omic studies reveal the pathogenic lipid droplet proteins in non-alcoholic fatty liver.” (2016)).*

Doudna et al (“The new frontier of genome engineering with CRISPR-Cas9.” Science 346.6213 (2014).*

Ding et al. (“Permanent alteration of PCSK9 with in vivo CRISPR-Cas9 genome editing.” Circulation research 115.5 (2014): 488-492), The FEBS journal 281.7 (2014): 1717-1725).*

Yin, Hao, et al. (“Therapeutic genome editing by combined viral and non-viral delivery of CRISPR system components in vivo.” Nature biotechnology 34.3 (2016): 328-333).*

Abul-Husn et al., an inventor, )“A protein-truncating HSD17B13 variant and protection from chronic liver disease.” New England Journal of Medicine 378.12 (2018): 1096-1106).*

Ma et al. (“17-beta hydroxysteroid dehydrogenase 13 is a hepatic retinol dehydrogenase associated with histological features of non-alcoholic fatty liver disease.” Hepatology 69.4 (2019): 1504-1519).*

Motomura et al. (“Is HSD17B13 genetic variant a protector for liver dysfunction? Future perspective as a potential therapeutic target.” Journal of Personalized Medicine 11.7 (2021): 619).*

Abul-Husn, et al., “A Protein-Truncating HSD17B13 Variant and Protection from Chronic Liver Disease,” The New England Journal of Medicine, 378(12):1096-1106, (Mar. 22, 2018).

Adam, et al., “Hydroxysteroid (17β) dehydrogenase 13 deficiency triggers hepatic steatosis and inflammation in mice,” The FASEB Journal, vol. 32:Epub ahead of print (Jan. 31, 2018).

Altschul, et al., “Basic Local Alignment Search Tool,” J. Mol. Biol., 215(3):403-410, (1990).

Altschul, et al., “Gapped BLAST and PSI-BLAST: a new generation of protein database search programs,” Nucleic Acids Res., 25(17):3389-3402, (1997).

Anstee, et al., “Genetic Factors That Affect Risk of Alcoholic and Nonalcoholic Fatty Liver Disease,” Gastroenterology, 150:1728-1744, (2016).

Brantly, et al. “Molecular basis of alpha-1-antitrypsin deficiency,” Am. J. Med., 84(6A):13-31, (1988).

Brasaemle, et al., “Isolation of Lipid Droplets from Cells by Density Gradient Centrifugation,” Curr. Protoc. Cell Biol., 3.15.1-3.15.12, (2005).

Brooks, et al., “Basics of Enzymatic Assays for HTS,” The Assay Guidance Manual, NIH, US National Library of Medicine, created May 1, 2012, updated Oct. 1, 2012.

Browning, et al., “Prevalence of Hepatic Steatosis in an Urban Population in the United States: Impact of Ethnicity,” Hepatology, 40(6):1387-1395, (2004).

Business Wire, “Arrowhead Pharmaceuticals Initiates Phase ½ Study of ARO-HSD in Normal Healthy Volunteers and Patients with NASH of Suspected NASH”, Mar. 3, 2020, pp. 1-2. businesswire.com/news/home/20200303005396/en/Arrowhead-Pharmaceuticals-Initiates-.

Chambers, et al., “Genome-wide association study identifies loci influencing concentrations of liver enzymes in plasma,” Nature Genetics, 43(11), 1131-1138 plus Online Methods and Supplementary Materials (Nov. 2011).

Cohen, et al., “Human Fatty Liver Disease: Old Questions and New Insights,” Science, 332(6037):1519-1523, (2011).

Denny, et al., “PheWAS: demonstrating the feasibility of a phenome-wide scan to discover gene-disease associations,” Bioinformatics, 26(9):1205-1210, (2010).

Denny, et al., “Systematic comparison of phenome-wide association study of electronic medical record data and genome-wide association study data,” Nat. Biotechnol., 31(12):1102-1110, (2013).

Dewey, et al. “Distribution and clinical impact of functional variants in 50,726 whole-exome sequences from the DiscovEHR Study,” Science, 354(6319): aaf6814, (2016).

Ding, et al., “Isolating lipid droplets from multiple species,” Nat. Protoc., 8(1):43-51, (2013).

Doan, et al., “Breast cancer prognosis predicted by nuclear receptor-coregulator networks,” Mol. Oncol., 8(5):998-1013, (2014).

Ducharme, et al., “Lipid Droplets in Lipogenesis and Lipolysis,” Endocrinology, 149(3):942-949, (Mar. 2008).

Edelman, et al., “Genetic analysis of nonalcoholic fatty liver disease within a Caribbean-Hispanic population,” Mol. Genetic. Genomic Med., 3(6):558-569, (2015).

Elphick, et al., “Conserved valproic-acid-induced lipid droplet formation in Dictyostelium and human hepatocytes identifies structurally active compounds,” Dis. Model. Mech., 5(2):231-240, (2012).

Feitosa, et al., “The ERLIN1-CHUK-CWF19L1 gene cluster influences liver fat deposition and hepatic inflammation in the NHLBI Family Heart Study,” Atherosclerosis, 218(1):175-180, (2013).

Ford, et al., “A new Assay for Picomole Levels of Androsterone and Testosterone Using Co-immobilized Luciferase, Oxidoreductase, and Steroid Dehydrogenase,” Analytical Biocehemistry, 110(1), 43-48, (1981).

GenBank: : Accession No. DR004209, “TC104687 Human liver, large insert, pCMV expression library *Homo sapiens* cDNA clone TC104687 5' similar to *Homo sapiens* similar to hydroxysteroid (17-beta) dehydrogenase 11; hydroxysteroid 17-beta dehydrogenase 11 (LOC205983), mRNA sequence,” submitted Jan. 2011. [Retrieved from the Internet Jun. 10, 2019: <URL: ncbi.nlm.nih.gov>].

Ghanbari, et al., “Genetic Variations in MicroRNA-Binding Sites Affect MicroRNA-Mediated Regulation of Several Genes Associated With Cardio-metabolic Phenotypes,” Circ. Cardiovasc. Genet., 8(3):473-486, (2015).

Gieger, et al., “New gene functions in megakaryopoiesis and platelet formation,” Nature, 480(7376): 201-208 plus Supplementary Information, (Apr. 24, 2012).

Haapaniemi et al., “CRISPR-Cas9 genome editing induces a p53-mediated DNA damage response,” Nat. Med. doi: 10.1038/s41591-018-0049-z, (Jun. 11, 2018, epub ahead of print).

Hassan et al., “Nonalcoholic fatty liver disease: a comprehensive review of a growing epidemic,” World. J. Gastroenterol. 20(34):12082-12101, (2014).

Hotta, et al., “Association of the rs738409 polymorphism in PNPLA3 with liver damage and the development of nonalcoholic fatty liver disease,” BMC Med. Genet., 11:172, (2010).

Huang, et al., “Expression and Characterization of a PNPLA3 Protein Isoform (1148M) Associated with Nonalcoholic Fatty Liver Disease,” J. Biol. Chem., 286(43):37085-37093, (2011).

Ihry et al., “p53 inhibits CRISPR-Cas9 engineering in human pluripotent stem cells,” Nat. Med. doi: 10.1038/s41591-018-0050-6 (Jun. 11, 2018, epub ahead of print).

Jequier, et al., “Water as an essential nutrient: the physiological basis of hydration,” Eur. J. Clin. Nutr., 64(2):115-123, (2010).

(56) References Cited

OTHER PUBLICATIONS

Jiang et al., "Structural Biology. A Cas9-guide RNA complex preorganized for target DNA recognition," Science, 348(6242):1477-1481, (2015).

Jinek et al., "RNA-programmed genome editing in human cells," eLife, 2:e00471, (2013).

Kahali, et al., "Insights from Genome-Wide Association Analyses of Nonalcoholic Fatty Liver Disease," Semin. Liver Dis., 35(4):375-391, (2015).

Kampf, et al., "The human liver-specific proteome defined by transcriptomics and antibody-based profiling," The FASEB Journal, vol. 28:2901-2914, (Jul. 2014).

Karlson, "Introduction to Modern Biochemistry, Enzymes and Biocatalysis," Fourth Edition, Chapter V, pp. 74-100, (1974).

Kitamoto et al., "Association of polymorphisms in GCKR and TRIB1 with nonalcoholic fatty liver disease and metabolic syndrome traits," Endocr. J. 61(7):683-689, (2014).

Kitamoto, et al., "Genome-wide scan revealed that polymorphisms in the PNPLA3, SAMM50, and PARVB genes are associated with development and progression of nonalcoholic fatty liver disease in Japan," Hum. Genet., 132(7):783-792, (2013).

Kleiner, et al., "Design and Validation of a Histological Scoring System for Nonalcoholic Fatty Liver Disease," Hepatology, 41(6):1313-1321, (2005).

Kochanek, et al., "Deaths: Final Data for 2014," Natl. Viral Stat. Rep., 65(4):1-122, (2016).

Komor et al., "CRISPR-Based Technologies for the Manipulation of Eukaryotic Genomes," Cell, 168(1-2):20-36, (2017).

Koonin, et al., "Diversity, classification and evolution of CRISPR-Cas systems," Current Opinion in Microbiology, 37:67-78, (2017).

Kosicki et al., "Repair of double-strand breaks induced by CRISPR-Cas9 leads to large deletions and complex rearrangements," Nat. Biotechnol., 36(8): 765-771, (Jul. 16, 2018).

Kozlitina, et al., "Exome-wide association study identifies a TM6SF2 variant that confers susceptibility to nonalcoholic fatty liver disease," Nat. Genet., 46(4):352-356, (2014).

Krazeisen, et al., "Phytoestrogens inhibit human 17β-hydroxysteroid dehydrogenase type 5," Molecular and Cellular Endocrimology, 171(1-2):151-162, (2001).

Kuhl, "Pharmacology of estrogens and progestogens: influence of different routes of administration," Climacteric, 8(Suppl 1):3-63, (2005).

Labrie, "Multiple intracrine hormonal targets in the prostate: opportunities and challenges," BJU Int., 100 Suppl 2:48-51, (2007).

Lazo, et al., "Prevalence of Nonalcoholic Fatty Liver Disease in the United States: the Third National Health and Nutrition Examination Survey, 1988-1994," Am. J. Epidemiol., 178(1):38-45, (2013).

Leippe, et al., "Bioluminescent Nicotinamide Adenine Dinucleotide Detection Assays Part 1: Technology and Features," (2014), https://www.promega.com/resources/pubhub/bioluminescent-nicotinamide-adenine-dinucleotide-detection-assays/.

Li, et al. "LTB4 causes macrophage—mediated inflammation and directly induces insulin resistance in obesity," Nat. Med., 21(3):239-247, (2015).

Li, et al., "Fast and accurate short read alignment with Burrows—Wheeler transform," Bioinformatics, 25(14):1754-1760, (2009).

Liu, et al., "Molecular cloning and expression analysis of a new gene for short-chain dehydrogenase/reductase 9," Acta Biochim. Pol., 54(1):213-218, (2007).

Liu, et al. "TM6SF2 rs58542926 influences hepatic fibrosis progression in patients with non-alcoholic fatty liver disease," Nat. Commun., 5:4309, pp. 1-6, (2014).

Mahdessian, et al., "TM6SF2 is a regulator of liver fat metabolism influencing triglyceride secretion and hepatic lipid droplet content," Proc. Natl. Acad. Sci. U.S.A., 111(24):8913-8918, (2014).

Mashek, et al., "Hepatic Lipid Droplet Biology: Getting to the Root of Fatty Liver," Hepatology, 62(3):964-967, (2015).

Mckenna, et al., "The Genome Analysis Toolkit: a MapReduce framework for analyzing next-generation DNA sequencing data," Genome Res., 20(9):1297-1303, (2010).

Moeller, et al., "Integrated view on 17beta-hydroxysteroid dehydrogenases," Molecular and Cellular Endocrinology, 301:7-19, (2009).

Moeller, et al., "Multifunctionality of human 17β-hydroxysteroid dehydrogenases," Mol. Cell. Endocrinol., 248(1-2):47-55, (2006).

Morgan, et al., "Eradication of Hepatitis C Virus Infection and the Development of Hepatocellular Carcinoma," Ann. Intern. Med., 158(5 Pt 1):329-337 and W-158-W-160, (2013).

NCBI Reference Sequence: NM_001136230, "*Homo sapiens* hydroxysteroid 17-beta dehydrogenase 13 (HSD17B13), transcript variant B, mRNA," pp. 1-5, (2017).

NCBI Reference Sequence: NM_178135, "*Homo sapiens* hydroxysteroid 17-beta dehydrogenase 13 (HSD17B13), transcript variant A, mRNA," pp. 1-5, (2017).

NCBI Reference Sequence: NP_001129702, "17-beta-hydroxysteroid dehydrogenase 13 isoform B [*Homo sapiens*]," pp. 1-4, (2017).

NCBI Reference Sequence: NP_835236, "17-beta-hydroxysteroid dehydrogenase 13 isoform A precursor [*Homo sapiens*]," pp. 1-4, (2017).

Nemudryi et al., "TALEN and CRISPR/Cas Genome Editing Systems: Tools of Discovery," Acta 145-Naturae 6(3):19-40, (2014).

New England Biolabs Catalog (1998/1999), pp. 121 and 284, (1998).

Nishimasu et al., "Crystal Structure of Cas9 in Complex with Guide RNA and Target DNA," Cell, 156(5):935-949, (2014).

NP Cluster Report rs72613567, [Retrieved from the Internet Jun. 6, 2019 <URL: ncbi.nlm.nig.gov>].

Oniki, et al., "Influence of the PNPLA3 rs738409 Polymorphism on Non-Alcoholic Fatty Liver Disease and Renal Function among Normal Weight Subjects," PLoS One, 10(7):e0132640, (2015).

Pirazzi, et al., "Patatin-like phospholipase domain-containing 3 (PNPLA3) I148M (rs738409) affects hepatic VLDL secretion in humans and in vitro," J. Hepatol., 57(6):1276-1282, (2012).

Promega, "Technical Manual: NAD(P)H-Glo Detection System," TM398, pp. 1-15, (2017).

Pruim, et al., "LocusZoom: regional visualization of genome-wide association scan results," Bioinformatics, 26(18):2336-2337, (2010).

PubMed NCBI Search Results for ((CRISPR[Title] or Cas9[Title]) and ("2012/01/01"[PDATE]: "2017/01/22")), <https://www.ncbi.nlm.nih.gov/pubmed>, retrieved on Sep. 22, 2019.

Quadri, et al., "Mutations in SLC30A10 Cause Parkinsonism and Dystonia with Hypermanganesemia, Polycythemia, and Chronic Liver Disease," The American Journal of Human Genetics, 90:467-477 plus Supplemental Material, (Mar. 9, 2012).

Rao, et al., "Genotyping single nucleotide polymorphisms directly from genomic DNA by invasive cleavage reaction on microspheres," Nucleic Acids Res. 31(11):e66, (2003).

Ratziu, et al., "Current efforts and trends in the treatment of NASH," Journal of Hepatology, 62:S65-S75, (2015).

Reid, et al., "Launching genomics into the cloud: deployment of Mercury, a next generation sequence analysis pipeline," BMC Bioinformatics, 15:30, pp. 1-11, (2014).

Romeo, et al., "Genetic variation in PNPLA3 confers susceptibility to nonalcoholic fatty liver disease," Nat. Genet., 40(12):1461-1465, (2008).

Rotman, et al., "The Association of Genetic Variability in PNPLA3 with Histological Severity of Non-Alcoholic Fatty Liver Disease," Hepatology, 52(3):894-903, (2010).

Santa Cruz Biotechnology, "17β-HSD13 Antibody (K-14): sc-161285" [Retrieved from the Internet Jun. 1, 2016: <www.scbt.com/datasheet-161285-17betahsd13-k-14-antibody.html>].

Santa Cruz Biotechnology, "17β-HSD13 siRNA (m), shRNA and Lentiviral Particle Gene Silencers" [Retrieved from the Internet Jun. 1, 2016: <www.scbt.com/datasheet-108263-17beta-hsd13-sirna-m.html>].

Schiavinato, et al., "EMILIN-3, peculiar member of elastin microfibril interface-located protein (EMILIN) family, has distinct expression pattern, forms oligomeric assemblies, and serves as transforming growth factor β (TGF-β) antagonist," J. Biol. Chem., 287(14):11498-11515, (2012).

Shen, et al., "The rs738409 (I148M) variant of the PNPLA3 gene and cirrhosis: a meta-analysis," J. Lipid Res., 56(1):167-175, (2015).

(56) References Cited

OTHER PUBLICATIONS

Sivan et al., "Identification of Restriction Factors by Human Genome-Wide RNA Interference Screening of Viral Host Range Mutants Exemplified by Discovery of SAMD9 and WDR6 as Inhibitors of the Vaccinia Virus K1L-C7L-Mutant," MBio 6(4):e01122, (2015).
Sivan et al., "Identification of Restriction Factors by Human Genome-Wide RNA Interference Screening of Viral Host Range Mutants Exemplified by Discovery of SAMD9 and WDR6 as Inhibitors of the Vaccinia Virus K1L-C7L-Mutant," MBio 6(4):e01122, Supplemental Material, (2015).
Smagris, et al., "Inactivation of Tm6sf2, a Gene Defective in Fatty Liver Disease, Impairs Lipidation but Not Secretion pf Very Low Density Lipoproteins," J. Biol. Chem., 291(20:10659-10676, (2016).
Smith, et al., "Comparison of Biosequences," Advances in Applied Mathematics, 2:482-489, (1981).
Sookoian, et al., "A nonsynonymous gene variant in the adiponutrin gene is associated with nonalcoholic fatty liver disease severity," J. Lipid Res., 50(10):2111-2116, (2009).
Sookoian, et al., "Genetic Variation in Transmembrane 6 Superfamily Member 2 and the Risk of Nonalcoholic Fatty Liver Disease and Histological Disease Severity," Hepatology, 61(2):515-525, (2015).
Speliotes, et al., "Genome-Wide Association Analysis Identifies Variants Associated with Nonalcoholic Fatty Liver Disease That Have Distinct Effects on Metabolic Traits," PLoS Genet., 7(3):e1001324, (2011).
Stevens, et al,. "Analysis of single nucleotide polymorphisms with solid phase invasive cleavage reactions," Nucleic Acids Res. 29(16):e77, (2001).
Su et al., "Comparative proteomic study reveals 17β-HSD13 as a pathogenic protein in nonalcoholic fatty liver disease," Proc. Natl. Acad. Sci. U.S.A. 111(31):11437-11442, (2014).
Submitted SNP(ss) Report in Submission Format for NCBI Assay Id (ss#): ss557289122. Nov. 22, 2012, 1 printed page from www.ncbi.nlm.nih.gov/ (Year: 2012).
Sun et al., "The CRISPR/Cas9 system for gene editing and its potential application in pain research," Transl. Perioper. Pain Med. 1(3):22-33, (2016).
Tang, et al., "A mouse knockout library for secreted and transmembrane proteins," Nature Biotechnology, 28(7):749-755 plus Online Methods and Supplementary Information, (Jul. 2010).
Trepo, et al., "PNPLA3 gene in liver diseases," J. Hepatol., 65(2):399-412, (2016).
Tsai et al., "Defining and Improving the genome-wide specificities of CRISPR-Cas9 nucleases," Nat. Rev. Genetics, 17(5): 300-312, (2016).
UniProtKB-Q7Z5P4-1, "17-beta-hydroxysteroid dehydrogenase 13," p. 6, (2003).
UniProtKB-Q7Z5P4-2, "17-beta-hydroxysteroid dehydrogenase 13," pp. 6-7, (2003).
Van Der Meer, et al., "Association Between Sustained Virological Response and All-Cause Mortality Among Patients With Chronic Hepatitis C and Advanced Hepatic Fibrosis," JAMA, 308(24):2584-2593, (2012).
Victor, et al., "The Dallas Heart Study: a Population-Based Probability Sample for the Multidisciplinary Study of Ethnic Differences in Cardiovascular Health," Am. J. Cardiol., 93(12):1473-1480, (2004).
Willer, et al., "METAL: fast and efficient meta-analysis of genomewide association scans," Bioinformatics, 26(17):2190-2191, (2010).
Williams, et al., "Prevalence of nonalcoholic fatty liver disease and nonalcoholic steatohepatitis among a largely middle-aged population utilizing ultrasound and liver biopsy: a prospective study," Gastroenterology, 140(1):124-131, (2011).
Wolf, et al., "To err is human: Patient misinterpretations of prescription drug label instructions," Patient Educ. Couns., 67(3):293-300, (2007).
Wong, et al., "Nonalcoholic Steatohepatitis Is the Second Leading Etiology of Liver Disease Among Adults Awaiting Liver Transplantation in the United States," Gastroenterology, 148(3):547-555, (2015).
Yang, et al., "GCTA: a Tool for Genome-wide Complex Trait Analysis," Am. J. Hum. Genet., 88(1):76-82, (2011).
Younossi, et al., "Changes in the Prevalence of the Most Common Causes of Chronic Liver Diseases in the United States From 1988 to 2008," Clin. Gastroenterol. Hepatol., 9(6):524-530, (2011).
Yuan, et al., "Population-Based Genome-wide Association Studies Reveal Six Loci Influencing Plasma Levels of Liver Enzymes," Am. J. Hum. Genet., 83(4):520-528, (2008).
Zhang et al., "Omic studies reveal the pathogenic lipid droplet proteins in non-alcoholic fatty liver disease", Protein Cell, 8(1):4-13, (2017).
Zhang, et al., "PowerBLAST: a New Network BLAST Application for Interactive of Automated Sequence Analysis and Annotation," Genome Res., 7(6):649-656, (1997).
U.S. Appl. No. 15/875,192, Non-Final Office Action mailed Feb. 4, 2022.
U.S. Appl. No. 15/875,514, Non-Final Office Action mailed Jul. 10, 2019.
U.S. Appl. No. 15/875,514, Notice of Allowance mailed Jan. 22, 2020.
U.S. Appl. No. 15/875,514, Notice of Allowance mailed May 1, 2020.
U.S. Appl. No. 15/913,366, Final Office Action mailed May 5, 2022.
U.S. Appl. No. 15/913,366, Final Office Action mailed Sep. 22, 2020.
U.S. Appl. No. 15/913,366, Non-Final Office Action mailed Sep. 8, 2021.
U.S. Appl. No. 15/913,366, Non-Final Office Action mailed Feb. 4, 2020.
U.S. Appl. No. 16/157,503, Non-Final Office Action mailed Jun. 12, 2020.
U.S. Appl. No. 16/157,503, Notice of Allowance mailed Nov. 19, 2020.
U.S. Appl. No. 16/942,386, Non-Final Office Action mailed Dec. 17, 2021.
U.S. Appl. No. 16/942,386, Notice of Allowance mailed Jun. 7, 2022.
U.S. Appl. No. 16/942,386, Requirement for Restriction/Election mailed Aug. 16, 2021.
U.S. Appl. No. 17/178,420, Non-Final Office Action mailed Sep. 26, 2022.
U.S. Appl. No. 17/709,965, Non-Final Office Action mailed Oct. 14, 2022.
WIPO Application No. PCT/US2018/014357 PCT International Search Report and Written Opinion of the International Searching Authority mailed Jun. 20, 2018.
WIPO Application No. PCT/US2018/014454 PCT International Search Report and Written Opinion of the International Searching Authority mailed Jun. 6, 2018.
WIPO Application No. PCT/US2019/023079 PCT International Search Report and Written Opinion of the International Searching Authority mailed Jun. 26, 2019.
U.S. Appl. No. 16/942,386, filed Jul. 29, 2020, U.S. Pat. No. 11,485,958.
U.S. Appl. No. 15/875,514, filed Jan. 19, 2018, U.S. Pat. No. 10,787,647.
U.S. Appl. No. 62/581,918, filed Nov. 6, 2017.
U.S. Appl. No. 62/472,972, filed Mar. 17, 2017.
U.S. Appl. No. 62/449,335, filed Jan. 23, 2017.
Nicholson et al., "Progress and prospects of engineered sequence-specific DNA modulating technologies for the management of liver diseases," World J Hepatol 7(6): 859-873 (Apr. 28, 2015).
Wong et al., "WU-CRISPR: characteristics of functional guide RNAs for the CRISPR/Cas9 system," Genome Biol., 16:218, (Nov. 2, 2015).
Bernick et al., "Knockdown and overexpression of Unc-45b result in defective myofibril organization in skeletal muscles of zebrafish embryos," BMC Cell Biol., 11:70, (2010).
Cao et al., "The cytokine interleukin-6 is sufficient but not necessary to mimic the peripheral conditioning lesion effect on axonal growth," J. Neurosci., 26(20):5565-5573, (May 17, 2006).

(56) References Cited

OTHER PUBLICATIONS

Lee et al., "MEK2 is sufficient but not necessary for proliferation and anchorage-independent growth of SK-MEL-28 melanoma cells," PLoS ONE, 6(2):e17165, (Feb. 2011).
Li et al., "Overexpression and knockout of miR-126 both promote leukemogenesis," Blood, 126(17):2005-2015, (2015).
Liu et al., "Associations of Hydroxysteroid 17-beta Dehydrogenase 13 Variants with Liver Histology in Chinese Patients with Metabolic-associated Fatty Liver Disease," J. Clin. Transl. Hepatol., 9(2):194-202, (Feb. 22, 2021).
Luukkonen et al., "Hydroxysteroid 17-β dehydrogenase 13 variant increases phospholipids and protects against fibrosis in nonalcoholic fatty liver disease," JCI Insight, 5(5):e132158, (Mar. 12, 2020).
Motomura et al., "Is HSD17B13 Genetic Variant a Protector for Liver Dysfunction? Future Perspective as a Potential Therapeutic Target," J. Pers. Med., 11(619):1-12, (Jun. 30, 2021).
Waegemans et al., "Notch3 activation is sufficient but not required for inducing human T-lineage specification," J. Immunol., 193(12):5997-6004, (2014).
Sookoian et al., "Genetics Meets Therapy? Exome-wide Association Study Reveals a Loss-of-Function Variant in 17-Beta-Hydroxysteroid Dehydrogenase 13 That Protects Patients From Liver Damage and Nonalcoholic Fatty Liver Disease Progression," Hepatology, 69(2):907-910, (Feb. 2019).
Porteus, "Genome Editing: a New Approach to Human Therapeutics," Annu. Rev. Pharmacol. Toxicol., 56:163-190, (Nov. 9, 2015).
Vanlith et al., "Ex Vivo Hepatocyte Reprograming Promotes Homology-Directed DNA Repair to Correct Metabolic Disease in Mice After Transplantation," Hepatol. Commun., 3(4):558-573, (Feb. 15, 2019).
Yin et al., "Genome editing with Cas9 in adult mice corrects a disease mutation and phenotype," Nat. Biotechnol., 32(6):551-553, (2014).
Doench et al., "Rational design of highly active sgRNAs for CRISPR-Cas9-mediated gene inactivation," Nat. Biotechnol., 32(12): 1262-1267, (Dec 2014).
Fu et al., "High-frequency off-target mutagenesis induced by CRISPR-Cas nucleases in human cells," Nat. Biotechnol., 31(9): 822-826, Author Manuscript, (Sep. 2013).
Hsu et al., "Development and Applications of CRISPR-Cas9 for Genome Engineering," Cell, 157(6): 1262-1278, (Jun. 5, 2014).
Van Overbeek et al., "DNA Repair Profiling Reveals Nonrandom Outcomes at Cas9- Mediated Breaks," Mol. Cell, 63(4): 633-646, (Aug. 18, 2016).

* cited by examiner

| Description | Genotype | Case | Control | Genotypic OR (95% CI) | Allelic OR (95% CI) | P-value |
|---|---|---|---|---|---|---|
| Alcoholic liver disease (n=190) vs. Normal (n=29928) | T/T | 128 | 16084 | 1 (--) | | |
| | T/TA | 54 | 11754 | 0.58 (0.42-0.80) | 0.62 (0.48-0.81) | 1.82e-04 |
| | TA/TA | 8 | 2090 | 0.47 (0.23-0.97) | | |
| Alcoholic cirrhosis (n=124) vs. Normal (n=29928) | T/T | 85 | 16084 | 1 (--) | | |
| | T/TA | 36 | 11754 | 0.58 (0.39-0.86) | 0.56 (0.41-0.78) | 3.35e-04 |
| | TA/TA | 3 | 2090 | 0.27 (0.09-0.85) | | |
| Nonalcoholic liver disease (n=1857) vs. Normal (n=29928) | T/T | 1090 | 16084 | 1 (--) | | |
| | T/TA | 665 | 11754 | 0.83 (0.75-0.92) | 0.84 (0.78-0.91) | 1.31e-05 |
| | TA/TA | 102 | 2090 | 0.70 (0.57-0.87) | | |
| Nonalcoholic cirrhosis (n=374) vs. Normal (n=29928) | T/T | 231 | 16084 | 1 (--) | | |
| | T/TA | 127 | 11754 | 0.74 (0.60-0.93) | 0.74 (0.62-0.88) | 4.48e-04 |
| | TA/TA | 16 | 2090 | 0.51 (0.31-0.85) | | |
| Hepatocellular carcinoma (n=75) vs. Normal (n=29928) | T/T | 49 | 16084 | 1 (--) | | |
| | T/TA | 23 | 11754 | 0.65 (0.39-1.06) | 0.67 (0.45-1.00) | 4.66e-02 |
| | TA/TA | 3 | 2090 | 0.48 (0.15-1.56) | | |

| Transcript | Type | Description | Expression FPKM WT | Het | Hom |
|---|---|---|---|---|---|
| A | Known | | 188.4 | 88 | 3.2 |
| B | Known | Exon 2 skipped | 10.8 | 1.2 | 0 |
| C | Novel | Exon 6 skipped | 0.2 | 1.8 | 4.1 |
| D | Novel | Inclusion of G 3' of exon 6 | 5.7 | 103 | 185.6 |
| E | Novel | Additional exon between exons 3 and 4 | 0.9 | 0.5 | 0 |
| F | Novel | Read-through from exon 6 to intron 6 | 0.3 | 2.3 | 4.6 |
| G | Novel | Exon 2 skipped; inclusion of G 3' of exon 6 | 0.3 | 1.4 | 2.8 |
| H | Novel | E; inclusion of G 3' of exon 6 | 0 | 0.6 | 0.8 |

```
                                          E1                                          E2
A_Form   1 MNIILEILLLLITIIYSYLESLVKFFIPQRRKSVAGEIVLITGAGHGIGRQTTYEFAKRQSILVLWDINKRGVEET 76
B_Form   1 MNIILEILLLLITIIYSYLESLVKFFIPQRRKSVAGEIVLITGAGHGIGRQTTYEFAKRQSILVLWDINK......  70
C_Form   1 MNIILEILLLLITIIYSYLESLVKFFIPQRRKSVAGEIVLITGAGHGIGRQTTYEFAKRQSILVLWDINKRGVEET 76
D_Form   1 MNIILEILLLLITIIYSYLESLVKFFIPQRRKSVAGEIVLITGAGHGIGRQTTYEFAKRQSILVLWDINKRGVEET 76
E_Form   1 MNIILEILLLLITIIYSYLESLVKFFIPQRRKSVAGEIVLITGAGHGIGRQTTYEFAKRQSILVLWDINKRGVEET 76
F_Form   1 MNIILEILLLLITIIYSYLESLVKFFIPQRRKSVAGEIVLITGAGHGIGRQTTYEFAKRQSILVLWDINKRGVEET 76
G_Form   1 MNIILEILLLLITIIYSYLESLVKFFIPQRRKSVAGEIVLITGAGHGIGRQTTYEFAKRQSILVLWDINK......  70
H_Form   1 MNIILEILLLLITIIYSYLESLVKFFIPQRRKSVAGEIVLITGAGHGIGRQTTYEFAKRQSILVLWDINKRGVEET 76

                      E2                                   E3                          E3'
A_Form  77 AAECRKLGVTAHAYVVDCSNREEIYRSLNQVKKEVGDVTIVVNNAGTVYPADLLSTKDEEITKTFEVNILGHFW.. 150
B_Form  71 ..............................VKKEVGDVTIVVNNAGTVYPADLLSTKDEEITKTFEVNILGHFW.. 114
C_Form  77 AAECRKLGVTAHAYVVDCSNREEIYRSLNQVKKEVGDVTIVVNNAGTVYPADLLSTKDEEITKTFEVNILGHFW.. 150
D_Form  77 AAECRKLGVTAHAYVVDCSNREEIYRSLNQVKKEVGDVTIVVNNAGTVYPADLLSTKDEEITKTFEVNILGHFW.. 150
E_Form  77 AAECRKLGVTAHAYVVDCSNREEIYRSLNQVKKEVGDVTIVVNNAGTVYPADLLSTKDEEITKTFEVNILGHFWNG 152
F_Form  77 AAECRKLGVTAHAYVVDCSNREEIYRSLNQVKKEVGDVTIVVNNAGTVYPADLLSTKDEEITKTFEVNILGHFW.. 150
G_Form  71 ..............................VKKEVGDVTIVVNNAGTVYPADLLSTKDEEITKTFEVNILGHFW.. 114
H_Form  77 AAECRKLGVTAHAYVVDCSNREEIYRSLNQVKKEVGDVTIVVNNAGTVYPADLLSTKDEEITKTFEVNILGHFWNG 152

                  E3'                            E4                        E5
A_Form 151 ......................ITKALLPSMMERNHGHIVTVASVCGHEGIPYLIPYCSSKFAAVGFHRGLTSELQ 204 ...
B_Form 115 ......................ITKALLPSMMERNHGHIVTVASVCGHEGIPYLIPYCSSKFAAVGFHRGLTSELQ 168 ...
C_Form 151 ......................ITKALLPSMMERNHGHIVTVASVCGHEGIPYLIPYCSSKFAAVGFHRGLTSELQ 204 ...
D_Form 151 ......................ITKALLPSMMERNHGHIVTVASVCGHEGIPYLIPYCSSKFAAVGFHRGLTSELQ 204 ...
E_Form 153 KDIRSNYLDVYRIEDTFGRDSEITKALLPSMMERNHGHIVTVASVCGHEGIPYLIPYCSSKFAAVGFHRGLTSELQ 228 ...
F_Form 151 ......................ITKALLPSMMERNHGHIVTVASVCGHEGIPYLIPYCSSKFAAVGFHRGLTSELQ 204 ...
G_Form 115 ......................ITKALLPSMMERNHGHIVTVASVCGHEGIPYLIPYCSSKFAAVGFHRGLTSELQ 168 ...
H_Form 153 KDIRSNYLDVYRIEDTFGRDSEITKALLPSMMERNHGHIVTVASVCGHEGIPYLIPYCSSKFAAVGFHRGLTSELQ 228 ...
```

*FIG. 7*

```
                E5                            E6                            E7
A_Form 205 ALGKTGIKTSCLCPVFVNTGFTKNPSTRLWPVLETDEVVRSLIDGILTNKKMIFVPSYINIFLRLQKFLPERASAI 280
B_Form 169 ALGKTGIKTSCLCPVFVNTGFTKNPSTRLWPVLETDEVVRSLIDGILTNKKMIFVPSYINIFLRLQKFLPERASAI 244
C_Form 205 ALGKTGIKTSCLCPVFVNTGFTKNPSTR.......................................FLPERASAI 241
D_Form 205 ALGKTGIKTSCLCPVFVNTGFTKNPSTRLWPVLETDEVVRSLIDGILTNKKMIFVPSYINIFLRLQKVSS       274
E_Form 229 ALGKTGIKTSCLCPVFVNTGFTKNPSTRLWPVLETDEVVRSLIDGILTNKKMIFVPSYINIFLRLQKFLPERASAI 304
F_Form 205 ALGKTGIKTSCLCPVFVNTGFTKNPSTRLWPVLETDEVVRSLIDGILTNKKMIFVPSYINIFLRLQKLSTAQNIQI 280
G_Form 169 ALGKTGIKTSCLCPVFVNTGFTKNPSTRLWPVLETDEVVRSLIDGILTNKKMIFVPSYINIFLRLQKVSS       238
H_Form 229 ALGKTGIKTSCLCPVFVNTGFTKNPSTRLWPVLETDEVVRSLIDGILTNKKMIFVPSYINIFLRLQKVSS       298

                  E7
A_Form 281 LNRMQNIQFEAVVGHKIKMK 300 (SEQ ID NO: 12)
B_Form 245 LNRMQNIQFEAVVGHKIKMK 264 (SEQ ID NO: 13)
C_Form 242 LNRMQNIQFEAVVGHKIKMK 261 (SEQ ID NO: 14)
D_Form 274                      274 (SEQ ID NO: 15)
E_Form 305 LNRMQNIQFEAVVGHKIKMK 324 (SEQ ID NO: 16)
F_Form 281 LKHQ                 284 (SEQ ID NO: 17)
G_Form 238                      238 (SEQ ID NO: 18)
H_Form 298                      298 (SEQ ID NO: 19)
```

*FIG. 7 cont.*

| Description | Genotype | Case | Control | Genotypic OR (95% CI) | Allelic OR (95% CI) | P-value |
|---|---|---|---|---|---|---|
| Any liver disease (n=517) vs. Normal (n=4279) | T/T | 399 | 3238 | 1 (–) | | |
| | T/TA | 108 | 910 | 0.74 (0.57-0.97) | 0.70 (0.57-0.88) | 1.77e-03 |
| | TA/TA | 10 | 131 | 0.41 (0.21-0.83) | | |
| Alcoholic liver disease (n=223) vs. Normal (n=4279) | T/T | 167 | 3238 | 1 (–) | | |
| | T/TA | 52 | 910 | 0.85 (0.59-1.23) | 0.77 (0.57-1.04) | 7.65e-02 |
| | TA/TA | 4 | 131 | 0.37 (0.13-1.08) | | |
| Alcoholic cirrhosis (n=215) vs. Normal (n=4279) | T/T | 163 | 3238 | 1 (–) | | |
| | T/TA | 49 | 910 | 0.83 (0.57-1.20) | 0.72 (0.53-0.99) | 4.37e-02 |
| | TA/TA | 3 | 131 | 0.29 (0.09-0.97) | | |
| Nonalcoholic liver disease (n=212) vs. Normal (n=4279) | T/T | 170 | 3238 | 1 (–) | | |
| | T/TA | 38 | 910 | 0.61 (0.41-0.91) | 0.63 (0.45-0.88) | 7.84e-03 |
| | TA/TA | 4 | 131 | 0.45 (0.16-1.29) | | |
| Nonalcoholic cirrhosis (n=100) vs. Normal (n=4279) | T/T | 81 | 3238 | 1 (–) | | |
| | T/TA | 16 | 910 | 0.53 (0.29-0.97) | 0.65 (0.40-1.07) | 8.96e-02 |
| | TA/TA | 3 | 131 | 0.79 (0.23-2.74) | | |
| Hepatocellular carcinoma (n=44) vs. Normal (n=4279) | T/T | 34 | 3238 | 1 (–) | | |
| | T/TA | 8 | 910 | 0.65 (0.28-1.54) | 0.79 (0.42-1.52) | 4.85e-01 |
| | TA/TA | 2 | 131 | 0.93 (0.20-4.39) | | |

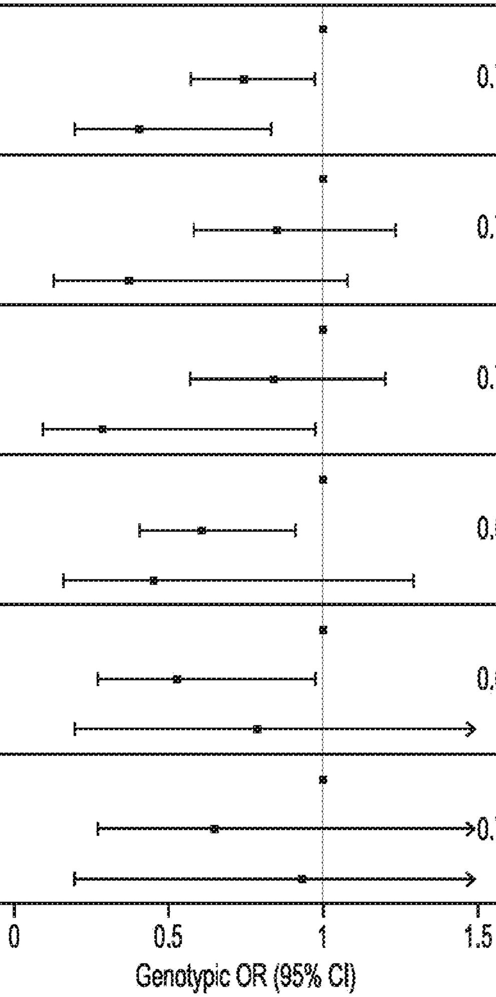

FIG. 8

HSD17B13 VARIANTS AND USES THEREOF

CROSS-REFERENCE TO RELATED APPLICATIONS

This application is a continuation of U.S. application Ser. No. 16/942,386, filed Jul. 29, 2020, which is a divisional of U.S. application Ser. No. 15/875,514, filed Jan. 19, 2018, which claims the benefit of U.S. Application No. 62/449,335, filed Jan. 23, 2017, U.S. Application No. 62/472,972, filed Mar. 17, 2017, and U.S. Application No. 62/581,918, filed Nov. 6, 2017, each of which is herein incorporated by reference in its entirety for all purposes.

REFERENCE TO A SEQUENCE LISTING SUBMITTED AS A TEXT FILE VIA EFS WEB

The Sequence Listing written in file 584669SEQLIST.xml is 2.09 megabytes, was created on Sep. 7, 2022, and is hereby incorporated by reference.

BACKGROUND

Chronic liver disease and cirrhosis are leading causes of morbidity and mortality in the United States, accounting for 38,170 deaths (1.5% of total deaths) in 2014 (Kochanek et al. (2016) *Natl Vital Stat Rep* 65:1-122, herein incorporated by reference in its entirety for all purposes). The most common etiologies of cirrhosis in the U.S. are alcoholic liver disease, chronic hepatitis C, and nonalcoholic fatty liver disease (NAFLD), together accounting for ~80% of patients awaiting liver transplant between 2004 and 2013 (Wong et al. (2015) *Gastroenterology* 148:547-555, herein incorporated by reference in its entirety for all purposes). The estimated prevalence of NAFLD in the U.S. is between 19 and 46 percent (Browning et al. (2004) *Hepatology* 40:1387-1395; Lazo et al. (2013) *Am J Epidemiol* 178:38-45; and Williams et al. (2011) Gastroenterology 140:124-131, each of which is herein incorporated by reference in its entirety for all purposes) and is rising over time (Younossi et al. (2011)*Clin Gastroenterol Hepatol* 9:524-530 e1; quiz e60 (2011), herein incorporated by reference in its entirety for all purposes), likely in conjunction with increased rates of obesity, its primary risk factor (Cohen et al. (2011). *Science* 332:1519-1523, herein incorporated by reference in its entirety for all purposes). While significant advances have been made in the treatment of hepatitis C (Morgan et al. (2013) *Ann Intern Med* 158:329-337 and van der Meer et al. (2012),*JAMA* 308:2584-2593, each of which is herein incorporated by reference in its entirety for all purposes), there are currently no evidence-based treatments for alcoholic or nonalcoholic liver disease and cirrhosis.

Previous genome wide association studies (GWAS) have identified a limited number of genes and variants associated with chronic liver disease. The most robustly validated genetic association to date is to a common missense variant in the patatin-like phospholipase domain containing 3 gene (PNPLA3 p.Ile148Met, rs738409), initially found to be associated with increased risk of nonalcoholic fatty liver disease (NAFLD) (Romeo et al. (2008) *Nat. Genet.* 40:1461-1465 and Speliotes et al. (2011) *PLoS Genet.* 7:e1001324, each of which is herein incorporated by reference in its entirety for all purposes), and subsequently found to be associated with disease severity (Rotman et al. (2010) *Hepatology* 52:894-903 and Sookoian et al. (2009) *J. Lipid Res.* 50:2111-2116, each of which is herein incorporated by reference in its entirety for all purposes) and progression (Trepo et al. (2016) *J. Hepatol.* doi:10.1016/j.jhep.2016.03.011, herein incorporated by reference in its entirety for all purposes). Variation in the transmembrane 6 superfamily member 2 (TM6SF2) gene has also been shown to confer increased risk for NAFLD (Kozlitina et al. (2014) *Nat. Genet.* 46:352-356; Liu et al. (2014) *Nat. Commun.* 5:4309, and Sookoian et al. (2015) *Hepatology* 61:515-525, each of which is herein incorporated by reference in its entirety for all purposes). The normal functions of these two proteins are not well understood, though both have been proposed to be involved in hepatocyte lipid metabolism. How variants in PNPLA3 and TM6SF2 contribute to increased risk of liver disease has yet to be elucidated. GWAS have also identified several genetic factors to be associated with serum alanine aminotransferase (ALT) and aspartate aminotransferase (AST) (Chambers et al. (2011) *Nat. Genet.* 43:131-1138 and Yuan et al. (2008) *Am. J. Hum. Genet.* 83:520-528, each of which is herein incorporated by reference in its entirety for all purposes), quantitative markers of hepatocyte injury and liver fat accumulation that are frequently measured clinically. To date, there are no described protective genetic variants for chronic liver disease. The discovery of protective genetic variants in other settings, such as loss-of-function variants in PCSK9 that reduce the risk of cardiovascular disease, has been the catalyst for development of new classes of therapeutics.

Knowledge of genetic factors underlying the development and progression of chronic liver disease could improve risk stratification and provide the foundation for novel therapeutic strategies. A better understanding of underlying genetic factors is needed to improve risk stratification and generate novel therapies for liver disease.

SUMMARY

Methods and compositions are provided related to the HSD17B13 rs72613567 variant gene, variant HSD17B13 transcripts, and variant HSD17B13 protein isoforms.

In one aspect, provided are isolated nucleic acids comprising the mutant residue from the HSD17B13 rs72613567 variant gene. Such isolated nucleic acids can comprise at least 15 contiguous nucleotides of an HSD17B13 gene and have a thymine inserted between nucleotides corresponding to positions 12665 and 12666 of SEQ ID NO: 1 when optimally aligned with SEQ ID NO: 1. Optionally, the contiguous nucleotides are at least 90%, at least 95%, at least 96%, at least 97%, at least 98%, or at least 99% identical to a corresponding sequence in SEQ ID NO: 2 including position 12666 of SEQ ID NO: 2 when optimally aligned with SEQ ID NO: 2. Optionally, the HSD17B13 gene is a human HSD17B13 gene. Optionally, the isolated nucleic acid comprises at least 15, at least 20, at least 25, at least 30, at least 35, at least 40, at least 45, at least 50, at least 60, at least 70, at least 80, at least 90, at least 100, at least 200, at least 300, at least 400, at least 500, at least 600, at least 700, at least 800, at least 900, at least 1000, at least 2000, at least 3000, at least 4000, at least 5000, at least 6000, at least 7000, at least 8000, at least 9000, at least 10000, at least 11000, at least 12000, at least 13000, at least 14000, at least 15000, at least 16000, at least 17000, at least 18000, or at least 19000 contiguous nucleotides of SEQ ID NO: 2.

Some such isolated nucleic acids comprise an HSD17B13 minigene in which one or more nonessential segments of the gene have been deleted with respect to a corresponding wild type HSD7B13 gene. Optionally, the deleted segments comprise one or more intronic sequences. Optionally, the isolated nucleic acid further comprises an intron corresponding to intron 6 of SEQ ID NO: 2 when optimally aligned with SEQ ID NO: 2. Optionally, the intron is intron 6 of SEQ ID NO: 2.

In another aspect, provided are isolated nucleic acids corresponding with different HSD17B13 mRNA transcripts or cDNAs. Some such isolated nucleic acids comprise at least 15 contiguous nucleotides encoding all or part of an HSD17B13 protein, wherein the contiguous nucleic acids comprise a segment that is at least 90%, at least 95%, at least 96%, at least 97%, at least 98%, at least 99%, or 100% identical to a segment present in SEQ ID NO: 7 (HSD17B13 Transcript D), SEQ ID NO: 10 (HSD17B13 Transcript G), and SEQ ID NO: 11 (HSD17B13 Transcript H) that is not present in SEQ ID NO: 4 (HSD17B13 Transcript A). Optionally, the contiguous nucleotides further comprise a segment that is at least 90%, at least 95%, at least 96%, at least 97%, at least 98%, at least 99%, or 100% identical to a segment present in SEQ ID NO: 7 (HSD17B13 Transcript D) that is not present SEQ ID NO: 11 (HSD17B13 Transcript H), and wherein the contiguous nucleotides further comprise a segment that is at least 90%, at least 95%, at least 96%, at least 97%, at least 98%, at least 99%, or 100% identical to a segment present in SEQ ID NO: 7 (HSD17B13 Transcript D) that is not present in SEQ ID NO: 10 (HSD17B13 Transcript G). Optionally, the contiguous nucleotides further comprise a segment that is at least 90%, at least 95%, at least 96%, at least 97%, at least 98%, at least 99%, or 100% identical to a segment present in SEQ ID NO: 11 (HSD17B13 Transcript H) that is not present in SEQ ID NO: 7 (HSD17B13 Transcript D). Optionally, the contiguous nucleotides further comprise a segment that is at least 90%, at least 95%, at least 96%, at least 97%, at least 98%, at least 99%, or 100% identical to a segment present in SEQ ID NO: 10 (HSD17B13 Transcript G) that is not present in SEQ ID NO: 7 (HSD17B13 Transcript D).

Some such isolated nucleic acids comprise at least 15 contiguous nucleotides encoding all or part of an HSD17B13 protein, wherein the contiguous nucleotides comprise a segment that is at least 90%, at least 95%, at least 96%, at least 97%, at least 98%, at least 99%, or 100% identical to a segment present in SEQ ID NO: 8 (HSD17B13 Transcript E) that is not present in SEQ ID NO: 4 (HSD17B13 Transcript A). Optionally, the contiguous nucleotides further comprise a segment that is at least 90%, at least 95%, at least 96%, at least 97%, at least 98%, at least 99%, or 100% identical to a segment present in SEQ ID NO: 8 (HSD17B13 Transcript E) that is not present in SEQ ID NO: 11 (HSD17B13 Transcript H).

Some such isolated nucleic acids comprise at least 15 contiguous nucleotides encoding all or part of an HSD17B13 protein, wherein the contiguous nucleotides comprise a segment that is at least 90%, at least 95%, at least 96%, at least 97%, at least 98%, at least 99%, or 100% identical to a segment present in SEQ ID NO: 9 (HSD17B13 Transcript F) that is not present in SEQ ID NO: 4 (HSD17B13 Transcript A).

Some such isolated nucleic acids comprise at least 15 contiguous nucleotides encoding all or part of an HSD17B13 protein, wherein the contiguous nucleotides comprise a segment that is at least 90%, at least 95%, at least 96%, at least 97%, at least 98%, at least 99%, or 100% identical to a segment present in SEQ ID NO: 6 (HSD17B13 Transcript C) that is not present in SEQ ID NO: 4 (HSD17B13 Transcript A).

Optionally, the HSD17B13 protein is a human HSD17B13 protein. Optionally, the isolated nucleic acid comprises at least 20, at least 25, at least 30, at least 35, at least 40, at least 45, at least 50, at least 60, at least 70, at least 80, at least 90, at least 100, at least 200, at least 300, at least 400, at least 500, at least 600, at least 700, at least 800, at least 900, at least 1000, or at least 2000 contiguous nucleotides encoding all or part of an HSD17B13 protein.

Some such isolated nucleic acids comprise a sequence at least 90%, at least 95%, at least 96%, at least 97%, at least 98%, at least 99%, or 100% identical to the sequence set forth in SEQ CD NO: 6, 7, 8, 9, 10, or 11 (HSD17B13 Transcript C, D, E, F, G, or H) and encoding an HSD17B13 protein comprising the sequence set forth in SEQ ID NO: 14, 15, 16, 17, 18, or 19 (HSD17B13 Isoform C, D, E, F, G, or H), respectively.

In any of the above nucleic acids, the contiguous nucleotides can optionally comprise sequence from at least two different exons of an HSD17B13 gene without an intervening intron.

In another aspect, provided are proteins encoded by any of the above isolated nucleic acids.

In another aspect, provided are isolated nucleic acids that hybridize to or near the mutant residue from the HSD17B13 rs72613567 variant gene. Such isolated nucleic acids can comprise at least 15 contiguous nucleotides that hybridize to an HSD17B13 gene at a segment that includes or is within 1000, 500, 400, 300, 200, 100, 50, 45, 40, 35, 30, 25, 20, 15, 10, or 5 nucleotides of a position corresponding to position 12666 in SEQ ID NO: 2 when optimally aligned with SEQ ID NO: 2. Optionally, the segment is at least 90%, at least 95%, at least 96%, at least 97%, at least 98%, or at least 99% identical to a corresponding sequence in SEQ ID NO: 2 when optimally aligned with SEQ ID NO: 2. Optionally, the segment comprises at least 20, 25, 30, 35, 40, 45, 50, 60, 70, 80, 90, 100, 200, 300, 400, 500, 600, 700, 800, 900, 1000, or 2000 contiguous nucleotides of SEQ ID NO: 2. Optionally, the segment includes position 12666 in SEQ ID NO: 2 or a position corresponding to position 12666 in SEQ ID NO: 2 when optimally aligned with SEQ ID NO: 2. Optionally, the HSD17B13 gene is a human HSD17B13 gene. Optionally, the isolated nucleic acid is up to about 30, 40, 50, 100, 200, 300, 400, 500, 600, 700, 800, 900, or 1000 nucleotides in length. Optionally, the isolated nucleic acid is linked to a heterologous nucleic acid or comprises a heterologous label. Optionally, the heterologous label is a fluorescent label.

In another aspect, provided are isolated nucleic acids that hybridize to different HSD17B13 mRNA transcripts or cDNAs. Some such isolated nucleic acids hybridize to at least 15 contiguous nucleotides of a nucleic acid encoding an HSD17B13 protein, wherein the contiguous nucleotides comprise a segment that is at least 90%, at least 95%, at least 96%, at least 97%, at least 98%, at least 99%, or 100% identical to a segment present in SEQ ID NO: 7 (HSD17B13 Transcript D), SEQ ID NO: 10 (HSD17B13 Transcript G), and SEQ ID NO: 11 (HSD17B13 Transcript H) that is not present within SEQ ID NO: 4 (HSD17B13 Transcript A).

Some such isolated nucleic acids hybridize to at least 15 contiguous nucleotides of a nucleic acid encoding an HSD17B13 protein, wherein the contiguous nucleotides comprise a segment that is at least 90%, at least 95%, at least 96%, at least 97%, at least 98%, or at least 99% identical to a segment present in SEQ ID NO: 8 (HSD17B13 Transcript E) and SEQ ID NO: 11 (HSD17B13 Transcript H) that is not present in SEQ ID NO: 4 (HSD17B13 Transcript A).

Some such isolated nucleic acids hybridize to at least 15 contiguous nucleotides of a nucleic acid encoding an HSD17B13 protein, wherein the contiguous nucleotides comprise a segment that is at least 90%, at least 95%, at least 96%, at least 97%, at least 98%, or at least 99% identical to a segment in SEQ ID NO: 9 (HSD17B13 Transcript F) that is not present in SEQ ID NO: 4 (HSD17B13 Transcript A).

Some such isolated nucleic acids hybridize to at least 15 contiguous nucleotides of a nucleic acid encoding an HSD17B13 protein, wherein the contiguous nucleotides comprise a segment that is at least 90%, at least 95%, at least 96%, at least 97%, at least 98%, or at least 99% identical to a segment present in SEQ ID NO: 6 (HSD17B13 Transcript C) that is not present in SEQ ID NO: 4 (HSD17B13 Transcript A).

Optionally, the HSD17B13 protein is a human HSD17B13 protein. Optionally, the isolated nucleic acid is up to about 30, 40, 50, 100, 200, 300, 400, 500, 600, 700, 800, 900, or 1000 nucleotides in length. Optionally, the isolated nucleic acid is linked to a heterologous nucleic acid or comprises a heterologous label. Optionally, the heterologous label is a fluorescent label.

Optionally, any of the above isolated nucleic acids comprise DNA. Optionally, any of the above isolated nucleic acids comprise RNA. Optionally, any of the above isolated nucleic acids are an antisense RNA, a short hairpin RNA, or a small-interfering RNA. Optionally, any of the above isolated nucleic acids can include a non-natural nucleotide.

In another aspect, provided are vectors and exogenous donor sequences comprising any of the above isolated nucleic acids and a heterologous nucleic acid sequence.

In another aspect, provided is the use of any of the above isolated nucleic acids, vectors, or exogenous donor sequences in a method of detecting an HSD17B13 rs72613567 variant in a subject, a method of detecting the presence of HSD17B13 Transcript C, D, E, F, G, or H in a subject, a method of determining a subject's susceptibility to developing a chronic liver disease, method of diagnosing a subject with fatty liver disease, or a method of modifying an HSD17B13 gene in a cell, a method for altering expression of an HSD17B13 gene in a cell.

In another aspect, provided are guide RNAs that target the HSD17B13 gene. Such guide RNAs can be effective to direct a Cas enzyme to bind to or cleave an HSD17B13 gene, wherein the guide RNA comprises a DNA-targeting segment that hybridizes to a guide RNA recognition sequence within the HSD17B13 gene. That is, such guide RNAs can be effective to direct a Cas enzyme to bind to or cleave an HSD17B13 gene, wherein the guide RNA comprises a DNA-targeting segment that targets a guide RNA target sequence within the HSD17B13 gene. Such guide RNAs can be effective to direct a Cas enzyme to bind to or cleave an HSD17B13 gene, wherein the guide RNA comprises a DNA-targeting segment that targets a guide RNA target sequence within the HSD17B13 gene that includes or is proximate to a position corresponding to position 12666 of SEQ ID NO: 2 when the HSD17B13 gene is optimally aligned with SEQ ID NO: 2. Optionally, the guide RNA target sequence comprises, consists essentially of, or consists of any one of SEQ ID NOS: 226-239 and 264-268. Optionally, the DNA-targeting segment comprises, consists essentially of, or consists of any one of SEQ ID NOS: 1629-1642 and 1648-1652. Optionally, the guide RNA comprises, consists essentially of, or consists of any one of SEQ ID NOS: 706-719; 936-949; 1166-1179, 1396-1409, 725-729, 955-959, 1185-1189, and 1415-1419. Optionally, the guide RNA target sequence is selected from SEQ ID NOS: 226-239 or SEQ ID NOS: 230 and 231. Optionally, the guide RNA target sequence is selected from SEQ ID NOS: 226-230 and 264-268. Optionally, the guide RNA target sequence is within a region corresponding to exon 6 and/or intron 6 of SEQ ID NO: 2 when the HSD17B13 gene is optimally aligned with SEQ ID NO: 2. Optionally, the guide RNA target sequence is within a region corresponding to exon 6 and/or intron 6 and/or exon 7 of SEQ ID NO: 2 when the HSD17B13 gene is optimally aligned with SEQ ID NO: 2. Optionally, the guide RNA target sequence is within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2. Optionally, the guide RNA target sequence includes the position corresponding to position 12666 of SEQ ID NO: 2 when the HSD17B13 gene is optimally aligned with SEQ ID NO: 2.

Such guide RNAs can be effective to direct a Cas enzyme to bind to or cleave an HSD17B13 gene, wherein the guide RNA comprises a DNA-targeting segment that targets a guide RNA target sequence within the HSD17B13 gene that includes or is proximate to the start codon of the HSD17B13 gene. Optionally, the guide RNA target sequence comprises, consists essentially of, or consists of any one of SEQ ID NOS: 20-81 and 259-263. Optionally, the DNA-targeting segment comprises, consists essentially of, or consists of any one of SEQ ID NOS: 1423-1484 and 1643-1647. Optionally, the guide RNA comprises, consists essentially of, or consists of any one of SEQ ID NOS: 500-561, 730-791, 960-1021, 1190-1251, 720-724, 950 954, 1180-1184, and 1410-1414. Optionally, the guide RNA target sequence is selected from SEQ CD NOS: 20-81 and 259-263. Optionally, the guide RNA target sequence is selected from SEQ ID NOS: 21-23, 33, and 35. Optionally, the guide RNA target sequence is selected from SEQ ID NOS: 33 and 35. Optionally, the guide RNA target sequence is within a region corresponding to exon 1 of SEQ ID NO: 2 when the HSD17B13 gene is optimally aligned with SEQ CD NO: 2. Optionally, the guide RNA target sequence is within about 1000, 500, 400, 300, 200, 100, 50, 45, 40, 35, 30, 25, 20, 15, 10, or 5 nucleotides of the start codon.

Such guide RNAs can be effective to direct a Cas enzyme to bind to or cleave an HSD17B13 gene, wherein the guide RNA comprises a DNA-targeting segment that targets a guide RNA target sequence within the HSD17B13 gene that includes or is proximate to the stop codon of the HSD17B13 gene. Optionally, the guide RNA target sequence comprises, consists essentially of, or consists of any one of SEQ ID NOS: 82-225. Optionally, the DNA-targeting segment comprises, consists essentially of, or consists of any one of SEQ ID NOS: 1485-1628. Optionally, the guide RNA comprises, consists essentially of, or consists of any one of SEQ ID NOS: 562-705, 792-935, 1022-1165, and 1252-1395. Optionally, the guide RNA target sequence is selected from SEQ ID NOS: 82-225. Optionally, the guide RNA target sequence is within a region corresponding to exon 7 of SEQ ID NO: 2 when the HSD17B13 gene is optimally aligned with SEQ ID NO: 2. Optionally, the guide RNA target sequence is within about 1000, 500, 400, 300, 200, 100, 50, 45, 40, 35, 30, 25, 20, 15, 10, or 5 nucleotides of the stop codon.

Optionally, the HSD17B13 gene is a human HSD17B13 gene. Optionally, the HSD17B13 gene comprises SEQ ID NO: 2.

Some such guide RNAs comprise a Clustered Regularly Interspaced Short Palindromic Repeats (CRISPR) RNA (crRNA) comprising the DNA-targeting segment and a trans-activating CRISPR RNA (tracrRNA). Optionally, the guide RNA is a modular guide RNA in which the crRNA and the tracrRNA are separate molecules that hybridize to each other. Optionally, the crRNA comprises, consists essentially of, or consists of the sequence set forth in SEQ CD NO: 1421 and the tracrRNA comprises, consists essentially of, or consists of the sequence set forth in SEQ ID NO: 1422. Optionally, the guide RNA is a single-guide RNA in which the crRNA is fused to the tracrRNA via a linker. Optionally, the single-guide RNA comprises, consists essentially of, or consists of the sequence set forth in any one of SEQ ID NOS: 1420 and 256-258.

In another aspect, provided are antisense RNAs, siRNAs, or shRNAs that hybridize to a sequence within an HSD17B13 transcript disclosed herein. Some such antisense RNAs, siRNAs, or shRNAs hybridize to a sequence within SEQ ID NO: 4 (HSD17B13 Transcript A). Optionally, the antisense RNA, siRNA, or shRNA can decrease expression of HSD17B13 Transcript A in a cell. Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the antisense RNA, siRNA, or shRNA hybridizes to a sequence within exon 7 or a sequence spanning the exon 6-exon 7 boundary of SEQ ID NO: 4 (HSD17B13 Transcript A). Some such anti sense RNAs, siRNAs, or shRNAs hybridize to a sequence within SEQ ID NO: 7 (HSD17B13 Transcript D). Optionally, the antisense RNA, siRNA, or shRNA can decrease expression of HSD17B13 Transcript D in a cell. Optionally, the antisense RNA, siRNA, or shRNA hybridizes to a sequence present in SEQ ID NO: 7 (HSD17B13 Transcript D) that is not present in SEQ ID NO: 4 (HSD17B13 Transcript A). Optionally, the anti sense RNA, siRNA, or shRNA hybridizes to a sequence within exon 7 or a sequence spanning the exon 6-exon 7 boundary of SEQ ID NO: 7 (HSD17B13 Transcript D).

In another aspect, provided are DNAs encoding any of the above guide RNAs, antisense RNAs, siRNAs, or shRNAs. In another aspect, provided are vectors comprising a DNA encoding any of the above guide RNAs, antisense RNAs, siRNAs, or shRNAs and a heterologous nucleic acid. In another aspect, provided is the use of any of the above guide RNAs, anti sense RNAs, siRNAs, or shRNAs DNAs encoding guide RNAs, antisense RNAs, siRNAs, or shRNAs or vectors comprising DNAs encoding guide RNAs, antisense RNAs, siRNAs, or shRNAs in a method of modifying an HSD17B13 gene in a cell or a method for altering expression of an HSD17B13 gene in a cell.

In another aspect, provided are compositions comprising any of the above isolated nucleic acids, any of the above guide RNAs, any of the above isolated polypeptides, any of the above anti sense RNAs, siRNAs, or shRNAs, any of the above vectors, or any of the above exogenous donor sequences. Optionally, the composition comprises any of the above guide RNAs and a Cas protein, such as a Cas9 protein. Optionally, such compositions comprise a carrier increasing the stability of the isolated polypeptide, the guide RNA, the antisense RNA, the siRNA, the shRNA, the isolated nucleic acid, the vector, or the exogenous donor sequence. Optionally, the carrier comprises a poly(lactic acid) (PLA) microsphere, a poly(D,L-lactic-coglycolic-acid) (PLGA) microsphere, a liposome, a micelle, an inverse micelle, a lipid cochleate, or a lipid microtubule.

Also provided are cells comprising any of the above isolated nucleic acids, any of the above guide RNAs, any of the above antisense RNAs, siRNAs, or shRNAs, any of the above isolated polypeptides, or any of the above vectors. Optionally, the cell is a human cell, a rodent cell, a mouse cell, or a rat cell. Optionally, any of the above cells are liver cells or pluripotent cells.

Also provided are uses of any of the above guide RNAs in a method of modifying an HSD17B13 gene in a cell or a method for altering expression of an HSD17B13 gene in a cell. Also provided are uses of any of the above antisense RNAs, siRNAs, or shRNAs in a method for altering expression of an HSD17B13 gene in a cell.

Also provided are methods of modifying a cell, modifying an HSD17B13 gene, or altering expression of an HSD17B13 gene. Some such methods are for modifying an HSD17B13 gene in a cell, comprising contacting the genome of the cell with: (a) a Cas protein; and (b) a guide RNA that forms a complex with the Cas protein and targets a guide RNA target sequence within the HSD17B13 gene, wherein the guide RNA target sequence includes or is proximate to a position corresponding to position 12666 of SEQ ID NO: 2 when the HSD17B13 gene is optimally aligned with SEQ ID NO: 2, wherein the Cas protein cleaves the HSD17B13 gene. Optionally, the Cas protein is a Cas9 protein. Optionally, the guide RNA target sequence comprises, consists essentially of, or consists of any one of SEQ ID NOS: 226-239 and 264-268. Optionally, the DNA-targeting segment comprises, consists essentially of, or consists of any one of SEQ ID NOS: 1629-1642 and 1648-1652. Optionally, the guide RNA comprises, consists essentially of, or consists of any one of SEQ ID NOS: 706-719; 936-949; 1166-1179, 1396-1409, 725-729, 955-959, 1185-1189, and 1415-1419. Optionally, the guide RNA target sequence is selected from SEQ ID NOS: 226-239, or wherein the guide RNA target sequence is selected from SEQ ID NOS: 230 and 231. Optionally, the guide RNA target sequence is selected from SEQ ID NOS: 226-239 and 264-268 or is selected from SEQ ID NOS: 264-268. Optionally, the guide RNA target sequence is within a region corresponding to exon 6 and/or intron 6 of SEQ ID NO: 2 when the HSD17B13 gene is optimally aligned with SEQ ID NO: 2. Optionally, the guide RNA target sequence is within a region corresponding to exon 6 and/or intron 6 and/or exon 7 of SEQ ID NO: 2 when the HSD17B13 gene is optimally aligned with SEQ ID NO: 2. Optionally, the guide RNA target sequence is within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2. Optionally, the guide RNA target sequence includes the position corresponding to position 12666 of SEQ ID NO: 2 when the HSD17B13 gene is optimally aligned with SEQ ID NO: 2.

Some such methods further comprise contacting the genome with an exogenous donor sequence comprising a 5' homology arm that hybridizes to a target sequence 5' of the position corresponding to position 12666 of SEQ ID NO: 2 and a 3' homology arm that hybridizes to a target sequence 3' of the position corresponding to position 12666 of SEQ ID NO: 2, wherein the exogenous donor sequence recombines with the HSD17B13 gene. Optionally, the exogenous donor sequence further comprises a nucleic acid insert flanked by the 5' homology arm and the 3' homology arm. Optionally, the nucleic acid insert comprises a thymine, and wherein upon recombination of the exogenous donor sequence with the HSD17B13 gene, the thymine is inserted between nucleotides corresponding to positions 12665 and 12666 of SEQ ID NO: 1 when the HSD17B13 gene is optimally aligned with SEQ ID NO: 1. Optionally, the exogenous donor sequence is between about 50 nucleotides to about 1 kb in length or between about 80 nucleotides to about 200 nucleotides in length. Optionally, the exogenous donor sequence is a single-stranded oligodeoxynucleotide.

Some such methods are for modifying an HSD17B13 gene in a cell, comprising contacting the genome of the cell with: (a) a Cas protein; and (b) a first guide RNA that forms a complex with the Cas protein and targets a first guide RNA target sequence within the HSD17B13 gene, wherein the first guide RNA target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81 or is selected from SEQ ID NOS: 20-81 and 259-263, wherein the Cas protein cleaves or alters expression of the HSD17B13 gene. Optionally, the first guide RNA target sequence comprises, consists essentially of, or consists of any one of SEQ ID NOS: 20-81 and 259-263. Optionally, the first guide RNA target sequence comprises, consists essentially of, or consists of any one of SEQ ID NOS: 20-41, any one of SEQ ID NOS: 21-23, 33, and 35, or any one of SEQ ID NOS: 33 and 35. Optionally, the first guide RNA comprises, consists essentially of, or consists of a DNA-targeting segment that comprises any one of SEQ ID NOS: 1423-1484 and 1643-1647. Optionally, the first guide RNA comprises, consists essentially of, or consists of a DNA-targeting segment that comprises any one of SEQ ID NOS: 1447-1468, any one of SEQ ID NOS: 1448-1450, 1460, and 1462; or any one of SEQ ID NOS: 1460 and 1462. Optionally, the first guide RNA comprises, consists essentially of, or consists of any one of SEQ ID NOS: 500-561, 730-791, 960-1021, 1190-1251, 720-724, 950-954, 1180-1184, and 1410-1414. Optionally, the first guide RNA comprises, consists essentially of, or consists of any one of SEQ ID NOS: 524 545, 754-775, 984-1005, and 1214-1235, or any one of SEQ ID NOS: 295-297, 525-527, 755 757, 985-987, 1215-1217, 307, 309, 537, 539, 767, 769, 997, 999, 1227, and 1229, or any one of SEQ ID NOS: 307, 309, 537, 539, 767, 769, 997, 999, 1227, and 1229. Optionally, the first guide RNA target sequence is selected from SEQ ID NOS: 20-41, is selected from SEQ ID NOS: 21-23, 33, and 35, or is selected from SEQ ID NOS: 33 and 35. Optionally, the Cas protein is a Cas9 protein. Optionally, the Cas protein is a nuclease-active Cas protein. Optionally, the Cas protein is a nuclease-inactive Cas protein fused to a transcriptional activator domain or a nuclease-inactive Cas protein fused to a transcriptional repressor domain.

Some such methods further comprise contacting the genome of the cell with a second guide RNA that forms a complex with the Cas protein and targets a second guide RNA target sequence within the HSD17B13 gene, wherein the second guide RNA target sequence comprises the stop codon for the HSD17B13 gene or is within about 10, 20, 30, 40, 50, 100, 200, 300, 400, 500, or 1,000 nucleotides of the stop codon or is selected from SEQ ID NOS: 82-225, wherein the cell is modified to comprise a deletion between the first guide RNA target sequence and the second guide RNA target sequence. Optionally, the second guide RNA target sequence comprises, consists essentially of, or consists of any one of SEQ ID NOS: 82-225. Optionally, the second guide RNA comprises, consists essentially of, or consists of a DNA-targeting segment that comprises any one of SEQ ID NOS: 1485-1628. Optionally, the second guide RNA comprises, consists essentially of, or consists of any one of SEQ ID NOS: 562-705, 792 935, 1022-1165, and 1252-1395.

Some such methods are for decreasing expression of an HSD17B13 gene in a cell or decreasing expression of a particular HSD17B13 transcript (e.g., Transcript A or Transcript D) in a cell. Some such methods are for decreasing expression of an HSD17B13 gene in a cell, comprising: contacting the genome of the cell with an antisense RNA, an siRNA, or an shRNA that hybridizes to a sequence within exon 7 of SEQ ID NO: 4 (HSD17B13 Transcript A) and decreases expression of HSD17B13 Transcript A. Some such methods are for decreasing expression of an HSD17B13 gene in a cell, comprising: contacting the genome of the cell with an antisense RNAs, an siRNA, or an shRNA that hybridizes to a sequence within an HSD17B13 transcript disclosed herein. In some such methods, the antisense RNA, siRNA, or shRNA hybridizes to a sequence within SEQ ID NO: 4 (HSD17B13 Transcript A). Optionally, the antisense RNA, siRNA, or shRNA can decrease expression of HSD17B13 Transcript A in a cell. Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the anti sense RNA, siRNA, or shRNA hybridizes to a sequence within exon 7 or a sequence spanning the exon 6-exon 7 boundary of SEQ ID NO: 4 (HSD17913 Transcript A). In some such methods, the antisense RNA, siRNA, or shRNA hybridizes to a sequence within SEQ ID NO: 7 (HSD17B13 Transcript D). Optionally, the anti sense RNA, siRNA, or shRNA can decrease expression of HSD17B13 Transcript Dina cell. Optionally, the antisense RNA, siRNA, or shRNA hybridizes to a sequence present in SEQ ID NO: 7 (HSD17B13 Transcript D) that is not present in SEQ ID NO: 4 (HSD17B13 Transcript A). Optionally, the antisense RNA, siRNA, or shRNA hybridizes to a sequence within exon 7 or a sequence spanning the exon 6-exon 7 boundary of SEQ ID NO: 7 (HSD17B13 Transcript D).

In any of the above methods for of modifying an HSD17B13 gene or altering expression of an HSD17B13 gene, the method can further comprise introducing an expression vector into the cell, wherein the expression vector comprises a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. Optionally, the recombinant HSD17B13 gene is a human gene. Optionally, the recombinant HSD17B13 gene is an HSD17B13 minigene in which one or more nonessential segments of the gene have been deleted with respect to a corresponding wild type HSD17B13 gene. Optionally, the deleted segments comprise one or more intronic sequences. Optionally, the HSD17B13 minigene comprises an intron corresponding to intron 6 of SEQ ID NO: 2 when optimally aligned with SEQ ID NO: 2.

In any of the above methods for of modifying an HSD17B13 gene or altering expression of an HSD17B13 gene, the method can further comprise introducing an expression vector into the cell, wherein the expression vector comprises a nucleic acid encoding an HSD171313 protein that is at least 90%, at least 95%, at least 96%, at least 97%, at least 98%, at least 99%, or 100% identical to SEQ ID NO: 15 (HSD17B13 Isoform D). Optionally, the nucleic acid encoding the HSD171313 protein is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

In any of the above methods for of modifying an HSD17B13 gene or altering expression of an HSD17B13 gene, the method can further comprise introducing an HSD17B13 protein or fragment thereof into the cell. Optionally, the HSD17B13 protein or fragment thereof is at least 90%, at least 95%, at least 96%, at least 97%, at least 98%, at least 99%, or 100% identical to SEQ ID NO: 15 (HSD17B13 Isoform D).

Some such methods are for modifying a cell, comprising introducing an expression vector into the cell, wherein the expression vector comprises a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. Optionally, the recombinant HSD17B13 gene is a human gene. Optionally, the recombinant HSD17B13 gene is an HSD17B13 minigene in which one or more nonessential segments of the gene have been deleted with respect to a corresponding wild type HSD17B13 gene. Optionally, the deleted segments comprise one or more intronic sequences. Optionally, the HSD17B13 minigene comprises an intron corresponding to intron 6 of SEQ ID NO: 2 when optimally aligned with SEQ ID NO: 2.

Some such methods are for modifying a cell, comprising introducing an expression vector into the cell, wherein the expression vector comprises a nucleic acid encoding an HSD17B13 protein that is at least 90%, at least 95%, at least 96%, at least 97%, at least 98%, at least 99%, or 100% identical to SEQ ID NO: 15 (HSD17B13 Isoform D). Optionally, the nucleic acid encoding the HSD171313 protein is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

Some such methods are for modifying a cell, comprising introducing an HSD17B13 protein or fragment thereof into the cell. Optionally, the HSD17B13 protein or fragment thereof is at least 90%, at least 95%, at least 96%, at least 97%, at least 98%, at least 99%, or 100% identical to SEQ ID NO: 15 (HSD17B13 Isoform D).

In any of the above methods of modifying a cell, modifying an HSD17B13 gene, or altering expression of an HSD17B13 gene, the cell can be a human cell, a rodent cell, a mouse cell, or a rat cell. Any of the cells can be pluripotent cells or differentiated cells. Any of the cells can be liver cells. In any of the above methods of modifying a cell, modifying an HSD17B13 gene, or altering expression of an HSD17B13 gene, the method or cell can be ex vivo or in vivo. The guide RNAs used in any of the above methods can be modular guide RNAs comprising separate crRNA and tracrRNA molecules that hybridize to each other or a single-guide RNA in which the crRNA portion is fused to the tracrRNA portion (e.g., by a linker).

In another aspect, provided are methods of treating a subject who has or is susceptible to developing a chronic liver disease. In another aspect, provided are methods of treating a subject who has or is susceptible to developing an alcoholic or nonalcoholic liver disease. Such subjects can be, for example, a subject who is not a carrier of the HSD17B13 rs72613567 variant or subject who is not a homozygous carrier of the HSD17B13 rs72613567 variant. Some such methods comprise a method of treating a subject who is not a carrier of the HSD17B13 rs72613567 variant and has or is susceptible to developing a chronic liver disease, comprising introducing into the subject: (a) a Cas protein or a nucleic acid encoding the Cas protein; (b) a guide RNA or a nucleic acid encoding the guide RNA, wherein the guide RNA forms a complex with the Cas protein and targets a guide RNA target sequence within an HSD17B13 gene, wherein the guide RNA target sequence includes or is proximate to a position corresponding to position 12666 of SEQ ID NO: 2 when the HSD17B13 gene is optimally aligned with SEQ ID NO: 2; and (c) an exogenous donor sequence comprising a 5' homology arm that hybridizes to a target sequence 5' of the position corresponding to position 12666 of SEQ ID NO: 2, a 3' homology arm that hybridizes to a target sequence 3' of the position corresponding to position 12666 of SEQ ID NO: 2, and a nucleic acid insert comprising a thymine flanked by the 5' homology arm and the 3' homology arm, wherein the Cas protein cleaves the HSD17B13 gene in a liver cell in the subject and the exogenous donor sequence recombines with the HSD17B13 gene in the liver cell, wherein upon recombination of the exogenous donor sequence with the HSD17B13 gene, the thymine is inserted between nucleotides corresponding to positions 12665 and 12666 of SEQ ID NO: 1 when the HSD17B13 gene is optimally aligned with SEQ ID NO: 1.

Optionally, the guide RNA target sequence is selected from SEQ ID NOS: 226-239, or wherein the guide RNA target sequence is selected from SEQ ID NOS: 230 and 231. Optionally, the guide RNA target sequence is selected from SEQ ID NOS: 226-239 and 264-268. Optionally, the guide RNA target sequence is within a region corresponding to exon 6 and/or intron 6 of SEQ ID NO: 2 when the HSD17B13 gene is optimally aligned with SEQ ID NO: 2. Optionally, the guide RNA target sequence is within a region corresponding to exon 6 and/or intron 6 and/or exon 7 of SEQ ID NO: 2 when the HSD17B13 gene is optimally aligned with SEQ ID NO: 2. Optionally, the guide RNA target sequence is within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2. Optionally, the guide RNA target sequence includes the position corresponding to position 12666 of SEQ ID NO: 2 when the HSD17B13 gene is optimally aligned with SEQ ID NO: 2.

Optionally, the exogenous donor sequence is between about 50 nucleotides to about 1 kb in length. Optionally, the exogenous donor sequence is between about 80 nucleotides to about 200 nucleotides in length. Optionally, the exogenous donor sequence is a single-stranded oligodeoxynucleotide.

Some such methods comprise a method of treating a subject who is not a carrier of the HSD17B13 rs72613567 variant and has or is susceptible to developing a chronic liver disease, comprising introducing into the subject: (a) a Cas protein or a nucleic acid encoding the Cas protein; (b) a first guide RNA or a nucleic acid encoding the first guide RNA, wherein the first guide RNA forms a complex with the Cas protein and targets a first guide RNA target sequence within an HSD17B13 gene, wherein the first guide RNA target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81 or is selected from SEQ ID NOS: 20-81 and 259-263; and (c) an expression vector comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1, wherein the Cas protein cleaves or alters expression of the HSD17B13 gene in a liver cell in the subject and the expression vector expresses the recombinant HSD17B13 gene in the liver cell in the subject. Some such methods comprise a method of treating a subject who is not a carrier of the HSD17B13 rs72613567 variant and has or is susceptible to developing a chronic liver disease, comprising introducing into the subject: (a) a Cas protein or a nucleic acid encoding the Cas protein; (b) a first guide RNA or a nucleic acid encoding the first guide RNA, wherein the first guide RNA forms a complex with the Cas protein and targets a first guide RNA target sequence within an HSD17B13 gene, wherein the first guide RNA target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81 or is selected from SEQ ID NOS: 20-81 and 259-263; and optionally (c) an expression vector comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1, wherein the Cas protein cleaves or alters expression of the HSD17B13 gene in a liver cell in the subject and the expression vector expresses the recombinant HSD17B13 gene in the liver cell in the subject.

Optionally, the first guide RNA target sequence is selected from SEQ ID NOS: 20 41, is selected from SEQ ID NOS: 21-23, 33, and 35, or is selected from SEQ ID NOS: 33 and 35. Optionally, the Cas protein is a nuclease-active Cas protein. Optionally, the Cas protein is a nuclease-inactive Cas protein fused to a transcriptional repressor domain.

Such methods can further comprise introducing into the subject a second guide RNA, wherein the second guide RNA forms a complex with the Cas protein and targets a second guide RNA target sequence within the HSD17B13 gene, wherein the second guide RNA target sequence comprises the stop codon for the HSD17B13 gene or is within about 10, 20, 30, 40, 50, 100, 200, 300, 400, 500, or 1,000 nucleotides of the stop codon or is selected from SEQ ID NOS: 82-225, wherein the Cas protein cleaves the HSD17B13 gene in the liver cell within both the first guide RNA target sequence and the second guide RNA target sequence, wherein the liver cell is modified to comprise a deletion between the first guide RNA target sequence and the second guide RNA target sequence.

Optionally, the recombinant HSD17B13 gene is an HSD17B13 minigene in which one or more nonessential segments of the gene have been deleted with respect to a corresponding wild type HSD17B13 gene. Optionally, the deleted segments comprise one or more intronic sequences. Optionally, the HSD17B13 minigene comprises an intron corresponding to intron 6 of SEQ ID NO: 2 when optimally aligned with SEQ ID NO: 2.

In any of the above therapeutic or prophylactic methods, the Cas protein can be a Cas9 proteins. In any of the above therapeutic or prophylactic methods, the subject can be a human. In any of the above therapeutic or prophylactic methods, the chronic liver disease can be a fatty liver disease, a nonalcoholic fatty liver disease (NAFLD), an alcoholic liver fatty liver disease, a cirrhosis, or a hepatocellular carcinoma. Likewise, in any of the above methods, the therapeutic or prophylactic method can be for a liver disease that is an alcoholic liver disease or a nonalcoholic liver disease.

Some such methods comprise a method of treating a subject who is not a carrier of the HSD17B13 rs72613567 variant and has or is susceptible to developing a chronic liver disease, comprising introducing into the subject: an anti sense RNA, an siRNA, or an shRNA that hybridizes to a sequence within exon 7 or a sequence spanning the exon 6-exon 7 boundary of SEQ ID NO: 4 (HSD17B13 Transcript A) and decreases expression of HSD17B13 Transcript A in a liver cell in the subject. Some such methods comprise a method of treating a subject who is not a carrier of the HSD17B13 rs72613567 variant and has or is susceptible to developing a chronic liver disease, comprising introducing into the subject: an antisense RNAs, an siRNA, or an shRNA that hybridizes to a sequence within an HSD17B13 transcript disclosed herein. Optionally, the antisense RNA, siRNA, or shRNA hybridizes to a sequence within SEQ ID NO: 4 (HSD17B13 Transcript A). Optionally, the antisense RNA, siRNA, or shRNA can decrease expression of HSD17B13 Transcript A in a cell. Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the antisense RNA, siRNA, or shRNA hybridizes to a sequence within exon 7 or a sequence spanning the exon 6-exon 7 boundary of SEQ ID NO: 4 (HSD17B13 Transcript A).

Optionally, such methods further comprise introducing an expression vector into the subject, wherein the expression vector comprises a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1, wherein the expression vector expresses the recombinant HSD17B13 gene in the liver cell in the subject.

Optionally, such methods further comprise introducing an expression vector into the subject, wherein the expression vector comprises a nucleic acid encoding an HSD17B13 protein that is at least 90%, at least 95%, at least 96%, at least 97%, at least 98%, at least 99%, or 100% identical to SEQ ID NO: 15 (HSD17B13 Isoform D), wherein the expression vector expresses the nucleic acid encoding the HSD17B13 protein in the liver cell in the subject. Optionally, the nucleic acid encoding the HSD17B13 protein is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

Optionally, such methods further comprise introducing a messenger RNA into the subject, wherein the messenger RNA encodes an HSD17B13 protein that is at least 90%, at least 95%, at least 96%, at least 97%, at least 98%, at least 99%, or 100% identical to SEQ ID NO: 15 (HSD17B13 Isoform D), wherein the mRNA expresses the HSD17B13 protein in the liver cell in the subject. Optionally, a complementary DNA reverse transcribed from the messenger RNA is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

Optionally, such methods further comprise introducing an HSD17B13 protein or fragment thereof into the subject. Optionally, the HSD17B13 protein or fragment thereof is at least 90%, at least 95%, at least 96%, at least 97%, at least 98%, at least 99%, or 100% identical to SEQ ID NO: 15 (HSD17B13 Isoform D).

Some such methods comprise a method of treating a subject who is not a carrier of the HSD17B13 rs72613567 variant and has or is susceptible to developing a chronic liver disease comprising introducing an expression vector into the subject, wherein the expression vector comprises a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1, wherein the expression vector expresses the recombinant HSD17B13 gene in a liver cell in the subject.

In any of the above methods, the recombinant HSD17B13 gene can be a human gene. In any of the above methods, the recombinant HSD17B13 gene can be at least 90%, at least 95%, at least 96%, at least 97%, at least 98%, or at least 99% identical to SEQ ID NO: 2 when optimally aligned with SEQ ID NO: 2. In any of the above methods, the recombinant HSD17B13 gene can be an HSD17B13 minigene in which one or more nonessential segments of the gene have been deleted with respect to a corresponding wild type HSD17B13 gene. Optionally, the deleted segments comprise one or more intronic sequences. Optionally, the HSD17B13 minigene comprises an intron corresponding to intron 6 of SEQ ID NO: 2 when optimally aligned with SEQ ID NO: 2.

Some such methods comprise a method of treating a subject who is not a carrier of the HSD17B13 rs72613567 variant and has or is susceptible to developing a chronic liver disease comprising introducing an expression vector into the subject, wherein the expression vector comprises a nucleic acid encoding an HSD17B13 protein that is at least 90%, at least 95%, at least 96%, at least 97%, at least 98%, at least 99%, or 100% identical to SEQ ID NO: 15 (HSD17B13 Isoform D), wherein the expression vector expresses the nucleic acid encoding the HSD17B13 protein in a liver cell in the subject. Optionally, the nucleic acid encoding the HSD17B13 protein is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

Some such methods comprise a method of treating a subject who is not a carrier of the HSD17B13 rs72613567 variant and has or is susceptible to developing a chronic liver disease comprising introducing a messenger RNA into the subject, wherein the messenger RNA encodes an HSD17B13 protein that is at least 90%, at least 95%, at least 96%, at least 97%, at least 98%, at least 99%, or 100% identical to SEQ ID NO: 15 (HSD17B13 Isoform D), wherein the mRNA expresses the HSD17B13 protein in the liver cell in the subject. Optionally, a complementary DNA reverse transcribed from the messenger RNA is at least 90%, at least 95%, at least 96%, at least 97%, at least 98%, at least 99%, or 100% identical to SEQ ID NO: 7 (HSD17B13 Transcript D) when optimally aligned with SEQ ID NO: 7.

Some such methods comprise a method of treating a subject who is not a carrier of the HSD17B13 rs72613567 variant and has or is susceptible to developing a chronic liver disease comprising introducing an HSD17B13 protein or fragment thereof into the liver of the subject. Optionally, the HSD17B13 protein or fragment thereof is at least 90%, at least 95%, at least 96%, at least 97%, at least 98%, at least 99%, or 100% identical to SEQ ID NO: 15 (HSD17B13 Isoform D).

In any of the above methods, the subject can be a human. In any of the above methods, the chronic liver disease can be nonalcoholic fatty liver disease (NAFLD), alcoholic liver fatty liver disease, cirrhosis, or hepatocellular carcinoma. Likewise, in any of the above methods, the therapeutic or prophylactic method can be for a liver disease that is an alcoholic liver disease or a nonalcoholic liver disease. In any of the above methods, the introducing into the subject can comprise hydrodynamic delivery, virus-mediated delivery, lipid-nanoparticle-mediated delivery, or intravenous infusion.

BRIEF DESCRIPTION OF THE FIGURES

FIG. 1A) and aspartate aminotransferase (AST; FIG. 1B) levels in the GHS discovery cohort. FIG. 1A shows that there were 31 variants in 16 genes significantly associated with ALT levels (N=41,414) at $P<1.0\times10^{-7}$. FIG. 1B shows that there were 12 variants in 10 genes significantly associated with AST levels (N=40,753) at $P<1.0\times10^{-7}$. All significant associations are shown in Table 2. There were thirteen variants in nine genes (indicated here by their gene name), including HSD17B13, that remained significantly associated with ALT or AST in a replication meta-analysis of three separate European-ancestry cohorts (Table 3). The association tests were well calibrated, as shown by exome-wide quantile-quantile plots and genomic control lambda values (FIG. 1A and FIG. 1B).

FIG. 3A shows a representation of Transcript A and expression data for Transcript A. FIG. 3B shows a representation of Transcript B and expression data for Transcript B. In Transcript B, exon 2 is skipped. FIG. 3C shows a representation of Transcript C and expression data for Transcript C. In Transcript C, exon 6 is skipped. FIG. 3D shows a representation of Transcript D and expression data for Transcript D. The asterisk in Transcript D illustrates insertion of G from rs72613567 at the 3' end of exon 6, which leads to premature truncation of the protein. Transcript D becomes the dominant transcript in homozygous carriers of the HSD17B13 splice variant. Gene expression is displayed in FPKM units (Fragments Per Kilobase of transcript per Million mapped reads). Insets in FIG. 3B and FIG. 3C show a zoomed-in view.

FIGS. 6A and 6D show that Transcripts E and H contain an additional exon between exons 3 and 4. FIG. 6B shows that Transcript F involves read-through from exon 6 to intron 6. FIG. 6C shows that in Transcript G, exon 2 is skipped. The asterisk in Transcripts G and H (FIGS. 6C and 6D, respectively) illustrates insertion of G from rs72613567 at the 3' end of exon 6, which leads to premature truncation of the protein. The transcripts are differentially expressed according to HSD17B13 genotype, as shown in the box plots. mRNA expression is displayed in FPKM units (Fragments Per Kilobase of transcript per Million mapped reads).

FIG. 7 shows a protein sequence alignment of HSD17B13 protein isoforms A-H (SEQ ID NOS: 12-19, respectively).

FIG. 8 shows that HSD17B13 rs72613567:TA is associated with reduced risk of alcoholic and nonalcoholic liver disease phenotypes. Specifically, FIG. 8 shows in the Dallas Liver Study, HSD17B13 rs72613567 was associated with lower odds of any liver disease in an allele dosage-dependent manner. Similar allele dosage-dependent effects were observed across liver disease subtypes. Odds ratios were calculated using logistic regression, with adjustment for age, $age^2$, gender, BMI, and self-reported ethnicity.

FIG. 10A shows a Western blot from HepG2 cells overexpressing HSD17B13 Transcripts A and D and shows that HSD17B13 Transcript D was translated to a truncated protein with lower molecular weight compared to HSD17B13 Transcript A. FIG. 10B shows HSD17B13 western blots from fresh frozen human liver and HEK293 cell samples. Human liver samples are from homozygous reference (T/T), heterozygous (T/TA), and homozygous alternate (TA/TA) carriers of the HSD 7B13 rs72613567 splice variant. Cell samples are from HEK293 cells overexpressing non-tagged HSD17B13 Transcripts A and D. HSD17B13 Transcript D was translated to a truncated protein IsoD with lower molecular weight than HSD17B13 IsoA. FIG. 10C shows HSD17B13 IsoD protein levels were lower than IsoA protein levels from both human liver (left) and cell (right) samples. Protein level normalized to actin is shown in the bar columns; ** P<0.001, *P<0.05. FIG. 10D shows enzymatic activity of HSD17B13 isoforms A and D to 17-beta estradiol (estradiol), leukotriene B4 (LTB4), and 13-Hydroxyoctadecadienoic acid (13(S)-HODE). HSD17B13 Isoform D shows <10% enzymatic activity of the corresponding values for Isoform A. FIG. 10E shows HSD17B13 Isoform D when overexpressed in HEK293 cells did not show much conversion of estradiol (substrate) to estrone (product) when measured in the culture media, while overexpressed HSD17B13 Isoform A showed robust conversion.

FIG. 11A shows RT-PCR of HSD17B13 from HEK 293 cells overexpressing HSD17B13 Transcripts A (IsoA) and D (IsoD), indicating that HSD17B13 IsoD RNA level was higher than IsoA RNA level. FIG. 11B shows a western blot from the same cell lines indicating that HSD17B13 Transcript D was translated to a truncated protein with lower molecular weight compared to HSD17B13 Transcript A. FIG. 11C shows that HSD17B13 IsoD protein levels were lower than IsoA protein levels although the RNA level was higher. HSD17B13 protein level was normalized to actin; *P<0.05.

FIG. 13A shows treatment with increasing concentrations of oleic acid increased triglyceride (TG) content to a similar extent in control (GFP overexpressing cells) and HSD17B13 Transcript A and D cell lines. FIG. 13B shows HSD17B13 Transcripts A and D RNA levels were similar in the cell lines. RNA levels are shown reads per kilobase of transcript per million mapped reads (RPKM). FIG. 13C shows a western blot from HepG2 cells overexpressing HSD17B13 Transcripts A and D. HSD17B13 Transcript D was translated to a truncated protein with lower molecular weight compared to HSD17B13 Transcript A. FIG. 13D shows HSD17B13 IsoD protein levels were lower than IsoA protein levels. Protein level normalized to actin, **P<0.01.

DEFINITIONS

Figure 1A:
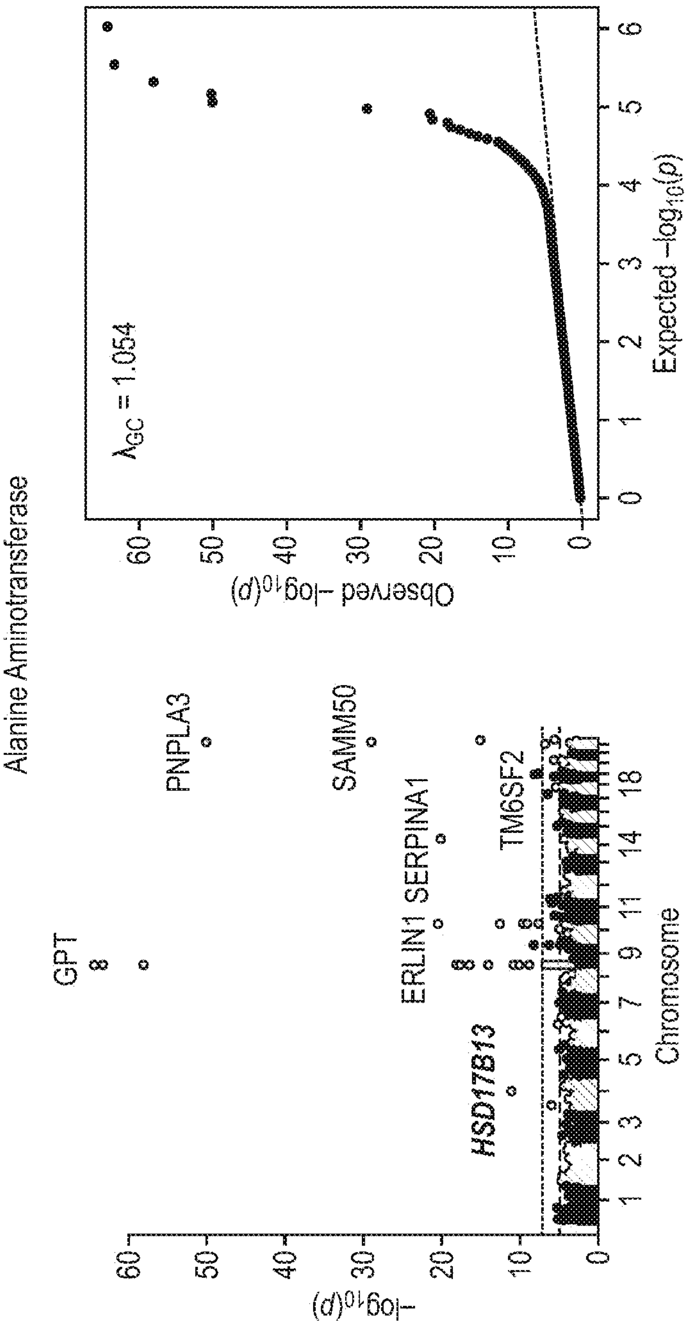
FIGS. 1A and 1B show Manhattan plots (left) and quantile-quantile plots (right) of single nucleotide variant associations with median alanine aminotransferase (ALT.

The terms "protein," "polypeptide," and "peptide," used interchangeably herein, include polymeric forms of amino acids of any length, including coded and non-coded amino acids and chemically or biochemically modified or derivatized amino acids. The terms also include polymers that have been modified, such as polypeptides having modified peptide backbones.

Proteins are said to have an "N-terminus" and a "C-terminus." The term "N-terminus" relates to the start of a protein or polypeptide, terminated by an amino acid with a free amine group (—NH2). The term "C-terminus" relates to the end of an amino acid chain (protein or polypeptide), terminated by a free carboxyl group (—COOH).

The terms "nucleic acid" and "polynucleotide," used interchangeably herein, include polymeric forms of nucleotides of any length, including ribonucleotides, deoxyribonucleotides, or analogs or modified versions thereof. They include single-, double-, and multi-stranded DNA or RNA, genomic DNA, cDNA, DNA-RNA hybrids, and polymers comprising purine bases, pyrimidine bases, or other natural, chemically modified, biochemically modified, non-natural, or derivatized nucleotide bases.

Nucleic acids are said to have "5' ends" and "3' ends" because mononucleotides are reacted to make oligonucleotides in a manner such that the 5' phosphate of one mononucleotide pentose ring is attached to the 3' oxygen of its neighbor in one direction via a phosphodiester linkage. An end of an oligonucleotide is referred to as the "5' end" if its 5' phosphate is not linked to the 3' oxygen of a mononucleotide pentose ring. An end of an oligonucleotide is referred to as the "3' end" if its 3' oxygen is not linked to a 5' phosphate of another mononucleotide pentose ring. A nucleic acid sequence, even if internal to a larger oligonucleotide, also may be said to have 5' and 3' ends. In either a linear or circular DNA molecule, discrete elements are referred to as being "upstream" or 5' of the "downstream" or 3' elements.

The term "wild type" includes entities having a structure and/or activity as found in a normal (as contrasted with mutant, diseased, altered, or so forth) state or context. Wild type genes and polypeptides often exist in multiple different forms (e.g., alleles).

The term "isolated" with respect to proteins and nucleic acid includes proteins and nucleic acids that are relatively purified with respect to other bacterial, viral, or cellular components that may normally be present in situ, up to and including a substantially pure preparation of the protein and the polynucleotide. The term "isolated" also includes proteins and nucleic acids that have no naturally occurring counterpart, have been chemically synthesized and are thus substantially uncontaminated by other proteins or nucleic acids, or has been separated or purified from most other cellular components with which they are naturally accompanied (e.g., other cellular proteins, polynucleotides, or cellular components).

"Exogenous" molecules or sequences include molecules or sequences that are not normally present in a cell in that form. Normal presence includes presence with respect to the particular developmental stage and environmental conditions of the cell. An exogenous molecule or sequence, for example, can include a mutated version of a corresponding endogenous sequence within the cell or can include a sequence corresponding to an endogenous sequence within the cell but in a different form (i.e., not within a chromosome). In contrast, endogenous molecules or sequences include molecules or sequences that are normally present in that form in a particular cell at a particular developmental stage under particular environmental conditions.

The term "heterologous" when used in the context of a nucleic acid or a protein indicates that the nucleic acid or protein comprises at least two portions that do not naturally occur together. Likewise, the term "heterologous" when used in the context of a promoter operably linked to a nucleic acid encoding a protein indicates that the promoter and the nucleic acid encoding the protein do not naturally occur together (i.e., are not naturally operably linked). For example, the term "heterologous," when used with reference to portions of a nucleic acid or portions of a protein, indicates that the nucleic acid or protein comprises two or more sub-sequences that are not found in the same relationship to each other (e.g., joined together) in nature. As one example, a "heterologous" region of a nucleic acid vector is a segment of nucleic acid within or attached to another nucleic acid molecule that is not found in association with the other molecule in nature. For example, a heterologous region of a nucleic acid vector could include a coding sequence flanked by sequences not found in association with the coding sequence in nature. Likewise, a "heterologous" region of a protein is a segment of amino acids within or attached to another peptide molecule that is not found in association with the other peptide molecule in nature (e.g., a fusion protein, or a protein with a tag). Similarly, a nucleic acid or protein can comprise a heterologous label or a heterologous secretion or localization sequence.

The term "label" refers to a chemical moiety or protein that is directly or indirectly detectable (e.g., due to its spectral properties, conformation, or activity) when attached to a target compound. The label can be directly detectable (fluorophore) or indirectly detectable (hapten, enzyme, or fluorophore quencher). Such labels can be detectable by spectroscopic, photochemical, biochemical, immunochemical, or chemical means. Such labels include, for example, radiolabels that can be measured with radiation-counting devices; pigments, dyes or other chromogens that can be visually observed or measured with a spectrophotometer; spin labels that can be measured with a spin label analyzer;

and fluorescent labels (fluorophores), where the output signal is generated by the excitation of a suitable molecular adduct and that can be visualized by excitation with light that is absorbed by the dye or can be measured with standard fluorometers or imaging systems. The label can also be, for example, a chemiluminescent substance, where the output signal is generated by chemical modification of the signal compound; a metal-containing substance; or an enzyme, where there occurs an enzyme-dependent secondary generation of signal, such as the formation of a colored product from a colorless substrate. The term "label" can also refer to a "tag" or hapten that can bind selectively to a conjugated molecule such that the conjugated molecule, when added subsequently along with a substrate, is used to generate a detectable signal. For example, one can use biotin as a tag and then use an avidin or streptavidin conjugate of horseradish peroxidate (HRP) to bind to the tag, and then use a calorimetric substrate (e.g., tetramethylbenzidine (TMB)) or a fluorogenic substrate to detect the presence of HRP. The term "label" can also refer to a tag that can be used, for example, to facilitate purification. Non-limiting examples of such tags include myc, HA, FLAG or 3XFLAG, 6XHis or polyhistidine, glutathione-S-transferase (GST), maltose binding protein, an epitope tag, or the Fc portion of immunoglobulin. Numerous labels are known and include, for example, particles, fluorophores, haptens, enzymes and their calorimetric, fluorogenic and chemiluminescent substrates and other labels.

"Codon optimization" takes advantage of the degeneracy of codons, as exhibited by the multiplicity of three-base pair codon combinations that specify an amino acid, and generally includes a process of modifying a nucleic acid sequence for enhanced expression in particular host cells by replacing at least one codon of the native sequence with a codon that is more frequently or most frequently used in the genes of the host cell while maintaining the native amino acid sequence. For example, a polynucleotide encoding a Cas9 protein can be modified to substitute codons having a higher frequency of usage in a given prokaryotic or eukaryotic cell, including a bacterial cell, a yeast cell, a human cell, a non-human cell, a mammalian cell, a rodent cell, a mouse cell, a rat cell, a hamster cell, or any other host cell, as compared to the naturally occurring nucleic acid sequence. Codon usage tables are readily available, for example, at the "Codon Usage Database." These tables can be adapted in a number of ways. See Nakamura et al. (2000) Nucleic Acids Research 28:292, herein incorporated by reference in its entirety for all purposes. Computer algorithms for codon optimization of a particular sequence for expression in a particular host are also available (see. e.g., Gene Forge).

The term "locus" refers to a specific location of a gene (or significant sequence), DNA sequence, polypeptide-encoding sequence, or position on a chromosome of the genome of an organism. For example, an "HSD17B13 locus" may refer to the specific location of an HSD17B13 gene, HSD17B13 DNA sequence, HSD17B13-encoding sequence, or HSD17B13 position on a chromosome of the genome of an organism that has been identified as to where such a sequence resides. An "HSD17B13 locus" may comprise a regulatory element of an HSD17B13 gene, including, for example, an enhancer, a promoter, 5' and/or 3' UTR, or a combination thereof.

The term "gene" refers to a DNA sequence in a chromosome that codes for a product (e.g., an RNA product and/or a polypeptide product) and includes the coding region interrupted with one or more non-coding introns and sequence located adjacent to the coding region on both the 5' and 3' ends such that the gene corresponds to the full-length mRNA (including the 5' and 3' untranslated sequences). The term "gene" also includes other non-coding sequences including regulatory sequences (e.g., promoters, enhancers, and transcription factor binding sites), polyadenylation signals, internal ribosome entry sites, silencers, insulating sequence, and matrix attachment regions. These sequences may be close to the coding region of the gene (e.g., within 10 kb) or at distant sites, and they influence the level or rate of transcription and translation of the gene. The term "gene" also encompasses "minigenes."

The term "minigene" refers to a gene in which one or more nonessential segments of the gene have been deleted with respect to a corresponding naturally occurring germline gene but in which at least one intron remains. Deleted segments can be intronic sequences. For example, deleted segments can be intronic sequences of at least about 500 base pairs to several kilobases. Typically, intronic sequences that do not encompass essential regulatory elements may be deleted. The gene segments comprising a minigene will typically be arranged in the same linear order as is present in the germline gene, but this will not always be the case. Some desired regulatory elements (e.g., enhancers, silencers) may be relatively position-insensitive so that the regulatory element will function correctly even if positioned differently in a minigene than in the corresponding germline gene. For example, an enhancer may be located at a different distance from a promoter, in a different orientation, and/or in a different linear order. For example, an enhancer that is located 3' to a promoter in germline configuration might be located 5' to the promoter in a minigene. Similarly, some genes may have exons which are alternatively spliced at the RNA level. Thus, a minigene may have fewer exons and/or exons in a different linear order than the corresponding germline gene and still encode a functional gene product. A cDNA encoding a gene product may also be used to construct a minigene (e.g., a hybrid cDNA-genomic fusion).

The term "allele" refers to a variant form of a gene. Some genes have a variety of different forms, which are located at the same position, or genetic locus, on a chromosome. A diploid organism has two alleles at each genetic locus. Each pair of alleles represents the genotype of a specific genetic locus. Genotypes are described as homozygous if there are two identical alleles at a particular locus and as heterozygous if the two alleles differ.

The term "variant" or "genetic variant" refers to a nucleotide sequence differing from the sequence most prevalent in a population (e.g., by one nucleotide). For example, some variations or substitutions in a nucleotide sequence alter a codon so that a different amino acid is encoded resulting in a genetic variant polypeptide. The term "variant" can also refer to a gene differing in sequence from the sequence most prevalent in a population at a position that does not change the amino acid sequence of the encoded polypeptide (i.e., a conserved change). Genetic variants can be associated with risk, associated with protection, or can be neutral.

A "promoter" is a regulatory region of DNA usually comprising a TATA box capable of directing RNA polymerase II to initiate RNA synthesis at the appropriate transcription initiation site for a particular polynucleotide sequence. A promoter may additionally comprise other regions which influence the transcription initiation rate. The promoter sequences disclosed herein modulate transcription of an operably linked polynucleotide. A promoter can be active in one or more of the cell types disclosed herein (e.g., a eukaryotic cell, a non-human mammalian cell, a human cell, a rodent cell, a pluripotent cell, a differentiated cell, or a combination thereof). A promoter can be, for example, a constitutively active promoter, a conditional promoter, an inducible promoter, a temporally restricted promoter (e.g., a developmentally regulated promoter), or a spatially restricted promoter (e.g., a cell-specific or tissue-specific promoter). Examples of promoters can be found, for example, in WO 2013/176772, herein incorporated by reference in its entirety for all purposes.

Examples of inducible promoters include, for example, chemically regulated promoters and physically-regulated promoters. Chemically regulated promoters include, for example, alcohol-regulated promoters (e.g., an alcohol dehydrogenase (alcA) gene promoter), tetracycline-regulated promoters (e.g., a tetracycline-responsive promoter, a tetracycline operator sequence (tetO), a tet-On promoter, or a tet-Off promoter), steroid regulated promoters (e.g., a rat glucocorticoid receptor, a promoter of an estrogen receptor, or a promoter of an ecdysone receptor), or metal-regulated promoters (e.g., a metalloprotein promoter). Physically regulated promoters include, for example temperature-regulated promoters (e.g., a heat shock promoter) and light-regulated promoters (e.g., a light-inducible promoter or a light-repressible promoter).

Tissue-specific promoters can be, for example, neuron-specific promoters, glia-specific promoters, muscle cell-specific promoters, heart cell-specific promoters, kidney cell-specific promoters, bone cell-specific promoters, endothelial cell-specific promoters, or immune cell-specific promoters (e.g., a B cell promoter or a T cell promoter).

Developmentally regulated promoters include, for example, promoters active only during an embryonic stage of development, or only in an adult cell.

"Operable linkage" or being "operably linked" includes juxtaposition of two or more components (e.g., a promoter and another sequence element) such that both components function normally and allow the possibility that at least one of the components can mediate a function that is exerted upon at least one of the other components. For example, a promoter can be operably linked to a coding sequence if the promoter controls the level of transcription of the coding sequence in response to the presence or absence of one or more transcriptional regulatory factors. Operable linkage can include such sequences being contiguous with each other or acting in trans (e.g., a regulatory sequence can act at a distance to control transcription of the coding sequence).

The term "primer" refers to an oligonucleotide capable of acting as a point of initiation of polynucleotide synthesis along a complementary strand when placed under conditions in which synthesis of a primer extension product complementary to a polynucleotide is catalyzed. Such conditions include the presence of four different nucleotide triphosphates or nucleoside analogs and one or more agents for polymerization, such as DNA polymerase and/or reverse transcriptase, in an appropriate buffer (including substituents which are cofactors, or which affect pH, ionic strength, and so forth), and at a suitable temperature. Extension of the primer in a sequence specific manner can include, for example, methods of PCR, DNA sequencing, DNA extension, DNA polymerization, RNA transcription, or reverse transcription. A primer must be sufficiently long to prime the synthesis of extension products in the presence of an agent for polymerase. A typical primer is at least about 5 nucleotides in length of a sequence substantially complementary to the target sequence, but longer primers are preferred. Typically, primers are about 15-30 nucleotides in length, but longer primers may also be employed. A primer sequence need not be exactly complementary to a template or target sequence but must be sufficiently complementary to hybridize with a template or target sequence. The term "primer pair" means a set of primers including a 5' upstream primer, which hybridizes to the 5' end of the DNA sequence to be amplified and a 3' downstream primer, which hybridizes to the complement of the 3' end of the sequence to be amplified. Primer pairs can be used for amplification of a target polynucleotide (e.g., by polymerase chain reaction (PCR) or other conventional nucleic-acid amplification methods). "PCR" or "polymerase chain reaction" is a technique used for the amplification of specific DNA segments (see U.S. Pat. Nos. 4,683,195 and 4,800,159, each of which is herein incorporated by reference in its entirety for all purposes).

The term "probe" refers to a molecule which can detectably distinguish between target molecules differing in structure. Detection can be accomplished in a variety of different ways depending on the type of probe used and the type of target molecule. Thus, for example, detection may be based on discrimination of activity levels of the target molecule, but preferably is based on detection of specific binding. Examples of such specific binding include antibody binding and nucleic acid probe hybridization. Thus, probes can include, for example, enzyme substrates, antibodies and antibody fragments, and nucleic acid hybridization probes. For example, a probe can be an isolated polynucleotide attached to a conventional detectable label or reporter molecule, such as a radioactive isotope, ligand, chemiluminescent agent, enzyme, or the like. Such a probe is complementary to a strand of a target polynucleotide, such as a polynucleotide comprising the HSD17B13 rs72613567 variant or specific HSD17B13 mRNA transcripts. Deoxyribonucleic acid probes may include those generated by PCR using HSD17B13-mRNA/cDNA-specific primers or HSD17B13-rs72613567-specific primers, oligonucleotide probes synthesized in vitro, or DNA obtained from bacterial artificial chromosome, fosmid, or cosmid libraries. Probes include not only deoxyribonucleic or ribonucleic acids but also polyamides and other probe materials that can specifically detect the presence of a target DNA sequence. For nucleic acid probes, detection reagents can include, for example, radiolabeled probes, enzymatic labeled probes (e.g., horse radish peroxidase and alkaline phosphatase), affinity labeled probes (e.g., biotin, avidin, and streptavidin), and fluorescent labeled probes (e.g., 6-FAM, VIC, TAMRA, MGB, fluorescein, rhodamine, and texas red). The nucleic acid probes described herein can readily be incorporated into one of the established kit formats which are well known.

The term "antisense RNA" refers to a single-stranded RNA that is complementary to a messenger RNA strand transcribed in a cell.

The term "small interfering RNA (siRNA)" refers to a typically double-stranded RNA molecule that induces the RNA interference (RNAi) pathway. These molecules can vary in length (generally between 18-30 base pairs) and contain varying degrees of complementarity to their target mRNA in the antisense strand. Some, but not all, siRNAs have unpaired overhanging bases on the 5' or 3' end of the sense strand and/or the antisense strand. The term "siRNA" includes duplexes of two separate strands, as well as single strands that can form hairpin structures comprising a duplex region. The double-stranded structure can be, for example, less than 20, 25, 30, 35, 40, 45, or 50 nucleotides in length. For example, the double-stranded structure can be from about 21-23 nucleotides in length, from about 19-25 nucleotides in length, or from about 19-23 nucleotides in length.

The term "short hairpin RNA (shRNA)" refers to a single strand of RNA bases that self-hybridizes in a hairpin structure and can induce the RNA interference (RNAi) pathway upon processing. These molecules can vary in length (generally about 50-90 nucleotides in length, or in some cases up to greater than 250 nucleotides in length, e.g., for microRNA-adapted shRNA). shRNA molecules are processed within the cell to form siRNAs, which in turn can knock down gene expression. shRNAs can be incorporated into vectors. The term "shRNA" also refers to a DNA molecule from which a short, hairpin RNA molecule may be transcribed.

"Complementarity" of nucleic acids means that a nucleotide sequence in one strand of nucleic acid, due to orientation of its nucleobase groups, forms hydrogen bonds with another sequence on an opposing nucleic acid strand. The complementary bases in DNA are typically A with T and C with G. In RNA, they are typically C with G and U with A. Complementarity can be perfect or substantial/sufficient. Perfect complementarity between two nucleic acids means that the two nucleic acids can form a duplex in which every base in the duplex is bonded to a complementary base by Watson-Crick pairing. "Substantial" or "sufficient" complementary means that a sequence in one strand is not completely and/or perfectly complementary to a sequence in an opposing strand, but that sufficient bonding occurs between bases on the two strands to form a stable hybrid complex in set of hybridization conditions (e.g., salt concentration and temperature). Such conditions can be predicted by using the sequences and standard mathematical calculations to predict the Tm (melting temperature) of hybridized strands, or by empirical determination of Tm by using routine methods. Tm includes the temperature at which a population of hybridization complexes formed between two nucleic acid strands are 50% denatured (i.e., a population of double-stranded nucleic acid molecules becomes half dissociated into single strands). At a temperature below the Tm, formation of a hybridization complex is favored, whereas at a temperature above the Tm, melting or separation of the strands in the hybridization complex is favored. Tm may be estimated for a nucleic acid having a known G+C content in an aqueous 1 M NaCl solution by using, e.g., Tm=81.5+0.41(% G+C), although other known Tm computations take into account nucleic acid structural characteristics.

"Hybridization condition" includes the cumulative environment in which one nucleic acid strand bonds to a second nucleic acid strand by complementary strand interactions and hydrogen bonding to produce a hybridization complex. Such conditions include the chemical components and their concentrations (e.g., salts, chelating agents, formamide) of an aqueous or organic solution containing the nucleic acids, and the temperature of the mixture. Other factors, such as the length of incubation time or reaction chamber dimensions may contribute to the environment. See. e.g., Sambrook et al., Molecular Cloning, A Laboratory Manual, 2.sup.nd ed., pp. 1.90-1.91, 9.47-9.51, 11.47-11.57 (Cold Spring Harbor Laboratory Press, Cold Spring Harbor, N.Y., 1989), herein incorporated by reference in its entirety for all purposes.

Hybridization requires that the two nucleic acids contain complementary sequences, although mismatches between bases are possible. The conditions appropriate for hybridization between two nucleic acids depend on the length of the nucleic acids and the degree of complementation, variables which are well known. The greater the degree of complementation between two nucleotide sequences, the greater the value of the melting temperature (Tm) for hybrids of nucleic acids having those sequences. For hybridizations between nucleic acids with short stretches of complementarity (e.g. complementarity over 35 or fewer, 30 or fewer, 25 or fewer, 22 or fewer, 20 or fewer, or 18 or fewer nucleotides) the position of mismatches becomes important (see Sambrook et al., supra, 11.7-11.8). Typically, the length for a hybridizable nucleic acid is at least about 10 nucleotides. Illustrative minimum lengths for a hybridizable nucleic acid include at least about 15 nucleotides, at least about 20 nucleotides, at least about 22 nucleotides, at least about 25 nucleotides, and at least about 30 nucleotides. Furthermore, the temperature and wash solution salt concentration may be adjusted as necessary according to factors such as length of the region of complementation and the degree of complementation.

The sequence of polynucleotide need not be 100% complementary to that of its target nucleic acid to be specifically hybridizable. Moreover, a polynucleotide may hybridize over one or more segments such that intervening or adjacent segments are not involved in the hybridization event (e.g., a loop structure or hairpin structure). A polynucleotide (e.g., gRNA) can comprise at least 70%, at least 80%, at least 90%, at least 95%, at least 99%, or 100% sequence complementarity to a target region within the target nucleic acid sequence to which they are targeted. For example, a gRNA in which 18 of 20 nucleotides are complementary to a target region, and would therefore specifically hybridize, would represent 90% complementarity. In this example, the remaining noncomplementary nucleotides may be clustered or interspersed with complementary nucleotides and need not be contiguous to each other or to complementary nucleotides.

Percent complementarity between particular stretches of nucleic acid sequences within nucleic acids can be determined routinely using BLAST programs (basic local alignment search tools) and PowerBLAST programs (Altschul et al. (1990) 0.1. *J Mol. Biol.* 215:403-410; Zhang and Madden (1997) *Genome Res.* 7:649-656) or by using the Gap program (Wisconsin Sequence Analysis Package, Version 8 for Unix, Genetics Computer Group, University Research Park, Madison Wis.), using default settings, which uses the algorithm of Smith and Waterman (Adv. Appl. Math., 1981, 2, 482-489).

The methods and compositions provided herein employ a variety of different components. Some components throughout the description can have active variants and fragments. Such components include, for example, Cas9 proteins, CRISPR RNAs, tracrRNAs, and guide RNAs. Biological activity for each of these components is described elsewhere herein.

"Sequence identity" or "identity" in the context of two polynucleotides or polypeptide sequences makes reference to the residues in the two sequences that are the same when aligned for maximum correspondence over a specified comparison window. When percentage of sequence identity is used in reference to proteins, residue positions which are not identical often differ by conservative amino acid substitutions, where amino acid residues are substituted for other amino acid residues with similar chemical properties (e.g., charge or hydrophobicity) and therefore do not change the functional properties of the molecule. When sequences differ in conservative substitutions, the percent sequence identity may be adjusted upwards to correct for the conservative nature of the substitution. Sequences that differ by such conservative substitutions are said to have "sequence similarity" or "similarity." Means for making this adjustment are well known. Typically, this involves scoring a conservative substitution as a partial rather than a full mismatch, thereby increasing the percentage sequence identity. Thus, for example, where an identical amino acid is given a score of 1 and a non-conservative substitution is given a score of zero, a conservative substitution is given a score between zero and 1. The scoring of conservative substitutions is calculated, e.g., as implemented in the program PC/GENE (Intelligenetics, Mountain View, California).

"Percentage of sequence identity" includes the value determined by comparing two optimally aligned sequences (greatest number of perfectly matched residues) over a comparison window, wherein the portion of the polynucleotide sequence in the comparison window may comprise additions or deletions (i.e., gaps) as compared to the reference sequence (which does not comprise additions or deletions) for optimal alignment of the two sequences. The percentage is calculated by determining the number of positions at which the identical nucleic acid base or amino acid residue occurs in both sequences to yield the number of matched positions, dividing the number of matched positions by the total number of positions in the window of comparison, and multiplying the result by 100 to yield the percentage of sequence identity. Unless otherwise specified (e.g., the shorter sequence includes a linked heterologous sequence), the comparison window is the full length of the shorter of the two sequences being compared.

Unless otherwise stated, sequence identity/similarity values include the value obtained using GAP Version 10 using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix; or any equivalent program thereof. "Equivalent program" includes any sequence comparison program that, for any two sequences in question, generates an alignment having identical nucleotide or amino acid residue matches and an identical percent sequence identity when compared to the corresponding alignment generated by GAP Version 10.

The term "conservative amino acid substitution" refers to the substitution of an amino acid that is normally present in the sequence with a different amino acid of similar size, charge, or polarity. Examples of conservative substitutions include the substitution of a non-polar (hydrophobic) residue such as isoleucine, valine, or leucine for another non-polar residue. Likewise, examples of conservative substitutions include the substitution of one polar (hydrophilic) residue for another such as between arginine and lysine, between glutamine and asparagine, or between glycine and serine. Additionally, the substitution of a basic residue such as lysine, arginine, or histidine for another, or the substitution of one acidic residue such as aspartic acid or glutamic acid for another acidic residue are additional examples of conservative substitutions. Examples of non-conservative substitutions include the substitution of a non-polar (hydrophobic) amino acid residue such as isoleucine, valine, leucine, alanine, or methionine for a polar (hydrophilic) residue such as cysteine, glutamine, glutamic acid or lysine and/or a polar residue for a non-polar residue. Typical amino acid categorizations are summarized below.

| | | | | | |
|---|---|---|---|---|---|
| Alanine | Ala | A | Nonpolar | Neutral | 1.8 |
| Arginine | Arg | R | Polar | Positive | −4.5 |
| Asparagine | Asn | N | Polar | Neutral | −3.5 |
| Aspartic acid | Asp | D | Polar | Negative | −3.5 |
| Cysteine | Cys | C | Nonpolar | Neutral | 2.5 |
| Glutamic acid | Glu | E | Polar | Negative | −3.5 |
| Glutamine | Gln | Q | Polar | Neutral | −3.5 |

-continued

| | | | | | |
|---|---|---|---|---|---|
| Glycine | Gly | G | Nonpolar | Neutral | −0.4 |
| Histidine | His | H | Polar | Positive | −3.2 |
| Isoleucine | Ile | I | Nonpolar | Neutral | 4.5 |
| Leucine | Leu | L | Nonpolar | Neutral | 3.8 |
| Lysine | Lys | K | Polar | Positive | −3.9 |
| Methionine | Met | M | Nonpolar | Neutral | 1.9 |
| Phenylalanine | Phe | F | Nonpolar | Neutral | 2.8 |
| Proline | Pro | P | Nonpolar | Neutral | −1.6 |
| Serine | Ser | S | Polar | Neutral | −0.8 |
| Threonine | Thr | T | Polar | Neutral | −0.7 |
| Tryptophan | Trp | W | Nonpolar | Neutral | −0.9 |
| Tyrosine | Tyr | Y | Polar | Neutral | −1.3 |
| Valine | Val | V | Nonpolar | Neutral | 4.2 |

A subject nucleic acid such as a primer or a guide RNA hybridizes to or targets a position or includes a position proximate to a specified nucleotide position in a reference nucleic acid when it is within about 1000, 500, 400, 300, 200, 100, 50, 45, 40, 35, 30, 25, 20, 15, 10, or 5 nucleotides of the position.

The term "biological sample" refers to a sample of biological material, within or obtainable from a subject, from which a nucleic acid or protein is recoverable. The term biological sample can also encompass any material derived by processing the sample, such as cells or their progeny. Processing of the biological sample may involve one or more of filtration, distillation, extraction, concentration, fixation, inactivation of interfering components, and the like. In some embodiments, a biological sample comprises a nucleic acid, such as genomic DNA, cDNA, or mRNA. In some embodiments, a biological sample comprises a protein. A subject can be any organism, including, for example, a human, a non-human mammal, a rodent, a mouse, or a rat. The biological sample can be derived from any cell, tissue, or biological fluid from the subject. The sample may comprise any clinically relevant tissue, such as a bone marrow sample, a tumor biopsy, a fine needle aspirate, or a sample of bodily fluid, such as blood, plasma, serum, lymph, ascitic fluid, cystic fluid, or urine. In some cases, the sample comprises a buccal swab. The sample used in the methods disclosed herein will vary based on the assay format, nature of the detection method, and the tissues, cells, or extracts that are used as the sample.

The term "control sample" refers to a sample obtained from a subject who does not have the HSD17B13 rs72613567 variant, and preferably is homozygous for the wild type allele of the HSD17B13 gene. Such samples can be obtained at the same time as a biological sample or on a different occasion. A biological sample and a control sample can both be obtained from the same tissue or bodily fluid.

A "homologous" sequence (e.g., nucleic acid sequence) includes a sequence that is either identical or substantially similar to a known reference sequence, such that it is, for example, at least 50%, at least 55%, at least 60%, at least 65%, at least 70%, at least 75%, at least 80%, at least 85%, at least 90%, at least 95%, at least 96%, at least 97%, at least 98%, at least 99%, or 100% identical to the known reference sequence. Homologous sequences can include, for example, orthologous sequence and paralogous sequences. Homologous genes, for example, typically descend from a common ancestral DNA sequence, either through a speciation event (orthologous genes) or a genetic duplication event (paralogous genes). "Orthologous" genes include genes in different species that evolved from a common ancestral gene by speciation. Orthologs typically retain the same function in the course of evolution. "Paralogous" genes include genes related by duplication within a genome. Paralogs can evolve new functions in the course of evolution.

The term "in vitro" includes artificial environments and to processes or reactions that occur within an artificial environment (e.g., a test tube). The term "in vivo" includes natural environments (e.g., a cell or organism or body, such as a cell within an organism or body) and to processes or reactions that occur within a natural environment. The term "ex vivo" includes cells that have been removed from the body of an individual and to processes or reactions that occur within such cells.

Compositions or methods "comprising" or "including" one or more recited elements may include other elements not specifically recited. For example, a composition that "comprises" or "includes" a protein may contain the protein alone or in combination with other ingredients. The transitional phrase "consisting essentially of" means that the scope of a claim is to be interpreted to encompass the specified elements recited in the claim and those that do not materially affect the basic and novel characteristic(s) of the claimed invention. Thus, the term "consisting essentially of" when used in a claim of this invention is not intended to be interpreted to be equivalent to "comprising."

"Optional" or "optionally" means that the subsequently described event or circumstance may or may not occur and that the description includes instances in which the event or circumstance occurs and instances in which it does not.

Designation of a range of values includes all integers within or defining the range, and all subranges defined by integers within the range.

Unless otherwise apparent from the context, the term "about" encompasses values within a standard margin of error of measurement (e.g., SEM) of a stated value.

The term "and/or" refers to and encompasses any and all possible combinations of one or more of the associated listed items, as well as the lack of combinations when interpreted in the alternative ("or").

The term "or" refers to any one member of a particular list and also includes any combination of members of that list.

The singular forms of the articles "a," "an," and "the" include plural references unless the context clearly dictates otherwise. For example, the term "a Cas9 protein" or "at least one Cas9 protein" can include a plurality of Cas9 proteins, including mixtures thereof.

Statistically significant means $p \leq 50.05$.

DETAILED DESCRIPTION

L Overview

Provided herein is an HSD17B13 variant discovered to be associated with reduced alanine and aspartate transaminase levels; a reduced risk of chronic liver diseases including nonalcoholic and alcoholic liver fatty liver disease, cirrhosis, and hepatocellular carcinoma; and reduced progression from simple steatosis to more clinically advanced stages of chronic liver disease. Also provided herein are previously unidentified transcripts of the HSD17B13 gene associated with the variant.

Isolated nucleic acids and proteins related to variants of HSD17B13, and cells comprising those nucleic acids and proteins are provided herein. Also provided are methods for modifying a cell through use of any combination of nuclease agents, exogenous donor sequences, transcriptional activators, transcriptional repressors, and expression vectors for expressing a recombinant HSD17B13 gene or a nucleic acid encoding an HSD17B13 protein. Also provided are therapeutic and prophylactic methods for treating a subject having or at risk of developing chronic liver disease.

II. HSD17B13 Variants

Provided herein are isolated nucleic acids and proteins related to variants of HSD17B13 (also known as hydroxysteroid 17-beta dehydrogenase 13, 17-beta-hydroxysteroid dehydrogenase 13, 17β-hydroxysteroid dehydrogenase-13, 170-HSD 13, short-chain dehydrogenase/reductase 9, SCDR9, HMFN0376, NIIL497, and SDR/6C3). The human HSD17B13 gene is approximately 19 kb in length and includes seven exons and six introns located at 4g22.1 in the genome. Exemplary human HSD17B13 protein sequences are assigned UniProt Accession No. Q7Z5P4 (SEQ ID NOS: 240 and 241; Q7Z5P4-1 and Q7Z5P4-2, respectively) and NCBI Reference Sequence Nos. NP 835236 and NP_001129702 (SEQ ID NOS: 242 and 243, respectively). Exemplary human HSD17B13 mRNAs are assigned NCBI Reference Sequence Nos. NM 178135 and NM 001136230 (SEQ ID NOS: 244 and 245, respectively).

In particular, provided herein is a splice variant of HSD17B13 (rs72613567) having an insertion of an adenine adjacent to the donor splice site in intron 6. The adenine is an insertion on the forward (plus) strand of the chromosome, which corresponds to an inserted thymine on the reverse (minus) strand of the chromosome. Because the human HSD17B13 gene is transcribed in the reverse direction, this nucleotide insertion is reflected as an inserted thymine in the exemplary HSD17B13 rs72613567 variant sequence provided in SEQ ID NO: 2 relative to the exemplary wild type HSD17B13 gene sequence provided in SEQ ID NO: 1. The insertion will therefore be referred to herein as a thymine inserted between positions 12665 and 12666 in SEQ ID NO: 1 or at position 12666 in SEQ ID NO: 2.

Figure 4:
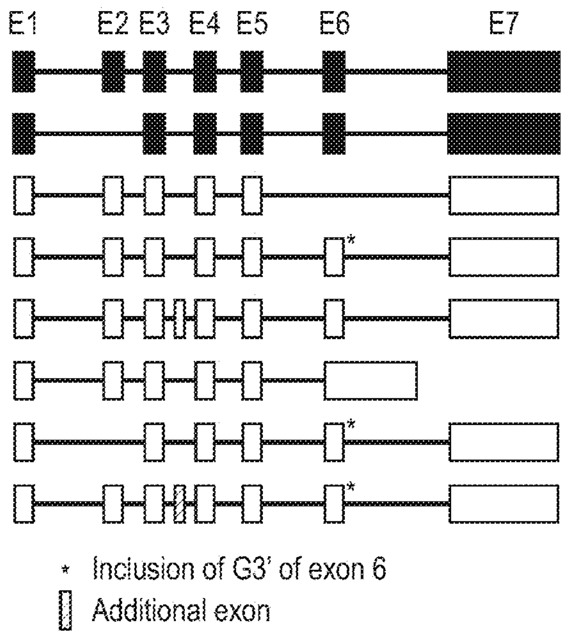
FIG. 4 shows that RNA-Seq studies of human liver reveal eight HSD17B13 transcripts, including six novel HSD17B13 transcripts (Transcripts C-H). Expression of the transcripts is displayed in FPKM units (fragments per kilobase of transcript per million mapped reads). Structures of the transcripts are provided on the right side of the figure.

Two mRNA transcripts (A and B; SEQ ID NOS: 4 and 5, respectively) were previously identified to be expressed in subjects with the wild type HSD17B13 gene. Transcript A includes all seven exons of the HSD17B13 gene, whereas exon 2 is skipped in Transcript B. Transcript A is the dominant transcript in wild type subjects. Provided herein, however, are six additional, previously unidentified, HSD17B13 transcripts that are expressed (C-H, SEQ ID NOS: 6 to 11, respectively). These transcripts are shown in FIG. 4. In Transcript C, exon 6 is skipped compared to Transcript A. In Transcript D, there is an insertion of a guanine 3' of exon 6, resulting in a frameshift in and premature truncation of exon 7 compared to Transcript A. In Transcript E, there is an additional exon between exons 3 and 4 compared to Transcript A. In Transcript F, which is expressed only in HSD17B13 rs72613567 variant carriers, there is read-through from exon 6 into intron 6 compared to Transcript A. In Transcript G, exon 2 is skipped, and there is an insertion of a guanine 3' of exon 6, resulting in a frameshift in and premature truncation of exon 7 compared to Transcript A. In Transcript H, there is an additional exon between exons 3 and 4, and there is an insertion of a guanine 3' of exon 6, resulting in a frameshift in and premature truncation of exon 7 compared to Transcript A. Transcripts C, D, F, G, and H are dominant in HSD17B13 rs72613567 variant carriers, with Transcript D being the most abundant transcript in carriers of the HSD17B13 rs72613567 variant. Also provided herein is one additional, previously unidentified, HSD17B13 transcript that is expressed at low levels (F', SEQ ID NO: 246). Like Transcript F, Transcript F' also includes a read-through from exon 6 into intron 6 compared to Transcript A, but, in contrast to Transcript F, the read-through does not include the inserted thymine present in the HSD17B13 rs72613567 variant gene. The nucleotide positions of the exons within the HSD17B13 genes for each Transcript are provided below.

Nucleotide Positions in SEQ ID NO: 1 for Exons of HSD17B13 Transcripts More Prevalent in Subjects Homozygous for Wild Type HSD17B13 Gene.

| | Transcript A | Transcript B | Transcript E | Transcript F' |
|---|---|---|---|---|
| Exon 1 | 1-275 | 1-275 | 1-275 | 1-275 |
| Exon 2 | 4471-4578 | skipped | 4471-4578 | 4471-4578 |
| Exon 3 | 5684-5815 | 5684-5815 | 5684-5815 | 5684-5815 |
| Exon 3' | not present | not present | 6210-6281 | not present |
| Exon 4 | 7308-7414 | 7308-7414 | 7308-7414 | 7308-7414 |
| Exon 5 | 8947-9084 | 8947-9084 | 8947-9084 | 8947-9084 |
| Exon 6 | 12548-12664 | 12548-12664 | 12548-12664 | 12548-13501* |
| Exon 7 | 17599-19118 | 17599-19118 | 17599-19118 | skipped |

*Includes read-through from exon 6 into intron 6; read-through = positions 12665-13501

Nucleotide Positions in SEQ ID NO: 2 for Exons of HSD17B13 Transcripts More Prevalent in Subjects Homozygous for rs72613567 HSD17B13 Variant Gene (Insertion of T at Position 12666).

| | Transcript C | Transcript D | Transcript F | Transcript G | Transcript H |
|---|---|---|---|---|---|
| Exon 1 | 1-275 | 1-275 | 1-275 | 1-275 | 1-275 |
| Exon 2 | 4471-4578 | 4471-4578 | 4471-4578 | skipped | 4471-4578 |
| Exon 3 | 5684-5815 | 5684-5815 | 5684-5815 | 5684-5815 | 5684-5815 |
| Exon 3' | not present | not present | not present | not present | 6210-6281 |
| Exon 4 | 7308-7414 | 7308-7414 | 7308-7414 | 7308-7414 | 7308-7414 |
| Exon 5 | 8947-9084 | 8947-9084 | 8947-9084 | 8947-9084 | 8947-9084 |
| Exon 6 | skipped | 12548-12665^ | 12548-13502* | 12548-12665^ | 12548-12665^ |
| Exon 7 | 17600-19119 | 17600-19119 | skipped | 17600-19119 | 17600-19119 |

^Includes additional residue 12665 at 3' end compared to Transcript A

*Includes read-through from exon 6 into intron 6; read-through = positions 12665-13502

As explained in more detail elsewhere herein, the HSD17B13 rs72613567 variant is associated with reduced alanine and aspartate transaminase levels and a reduced risk of chronic liver diseases including nonalcoholic and alcoholic liver fatty liver disease, cirrhosis, and hepatocellular carcinoma. The HSD17B13 rs72613567 variant is also associated with reduced progression from simple steatosis to more clinically advanced stages of chronic liver disease.

A. Nucleic Acids

Disclosed herein are isolated nucleic related to HSD17B13 variants and variant HSD17B13 transcripts. Also disclosed are isolated nucleic acids that hybridize under stringent or moderate conditions with any of the nucleic acids disclosed herein. Such nucleic acids can be useful, for example, to express HSD17B13 variant proteins or as primers, probes, exogenous donor sequences, guide RNAs, antisense RNAs, shRNAs, and siRNAs, each of which is described in more detail elsewhere herein.

Also disclosed are functional nucleic acids that can interact with the disclosed polynucleotides. Functional nucleic acids are nucleic acid molecules that have a specific function, such as binding a target molecule or catalyzing a specific reaction. Examples of functional nucleic acids include antisense molecules, aptamers, ribozymes, triplex forming molecules, and external guide sequences. The functional nucleic acid molecules can act as effectors, inhibitors, modulators, and stimulators of a specific activity possessed by a target molecule, or the functional nucleic acid molecules can possess a de Provo activity independent of any other molecules.

Antisense molecules are designed to interact with a target nucleic acid molecule through either canonical or non-canonical base pairing. The interaction of the antisense molecule and the target molecule is designed to promote the destruction of the target molecule through, for example, RNase-H-mediated RNA-DNA hybrid degradation. Alternatively, the anti sense molecule is designed to interrupt a processing function that normally would take place on the target molecule, such as transcription or replication. Antisense molecules can be designed based on the sequence of the target molecule. Numerous methods for optimization of antisense efficiency by finding the most accessible regions of the target molecule exist. Exemplary methods would be in vitro selection experiments and DNA modification studies using DMS and DEPC. Antisense molecules generally bind the target molecule with a dissociation constant ($k_d$) less than or equal to $10^{-6}$, $10^{-8}$, $10'^{-10}$, or $10^{-12}$. A representative sample of methods and techniques which aid in the design and use of antisense molecules can be found in the following non-limiting list of U.S. Pat. Nos. 5,135,917; 5,294,533; 5,627,158; 5,641,754; 5,691,317; 5,780,607; 5,786,138; 5,849,903; 5,856,103; 5,919,772; 5,955,590; 5,990,088; 5,994,320; 5,998,602; 6,005,095; 6,007,995; 6,013,522; 6,017,898; 6,018,042; 6,025,198; 6,033,910; 6,040,296; 6,046,004; 6,046,319; and 6,057,437, each of which is herein incorporated by reference in its entirety for all purposes. Examples of antisense molecules include antisense RNAs, small interfering RNAs (siRNAs), and short hairpin RNAs (shRNAs), which are described in greater detail elsewhere herein.

The isolated nucleic acids disclosed herein can comprise RNA, DNA, or both RNA and DNA. The isolated nucleic acids can also be linked or fused to a heterologous nucleic acid sequence, such as in a vector, or a heterologous label. For example, the isolated nucleic acids disclosed herein can be in a vector or exogenous donor sequences comprising the isolated nucleic acid and a heterologous nucleic acid sequence. The isolated nucleic acids can also be linked or fused to a heterologous label, such as a fluorescent label. Other examples of labels are disclosed elsewhere herein.

The disclosed nucleic acids molecules can be made up of, for example, nucleotides or non-natural or modified nucleotides, such as nucleotide analogs or nucleotide substitutes. Such nucleotides include a nucleotide that contains a modified base, sugar or phosphate group, or that incorporates a non-natural moiety in its structure. Examples of non-natural nucleotides include dideoxynucleotides, biotinylated, aminated, deaminated, alkylated, benzylated and fluorophor-labeled nucleotides.

The nucleic acids molecules disclosed herein can comprise one or more nucleotide analogs or substitutions. A nucleotide analog is a nucleotide which contains some type of modification to either the base, sugar, or phosphate moieties. Modifications to the base moiety would include natural and synthetic modifications of A, C, G, and T/U as well as different purine or pyrimidine bases, such as pseudouridine, uracil-5-yl, hypoxanthin-9-yl (I), and 2-aminoadenin-9-yl. Modified bases include, for example, 5-methylcytosine (5-me-C), 5-hydroxymethyl cytosine, xanthine, hypoxanthine, 2-aminoadenine, 6-methyl and other alkyl derivatives of adenine and guanine, 2-propyl and other alkyl derivatives of adenine and guanine, 2-thiouracil, 2-thiothymine and 2-thiocytosine, 5-halouracil and cytosine, 5-propynyl uracil and cytosine, 6-azo uracil, cytosine and thymine, 5-uracil (pseudouracil), 4-thiouracil, 8-halo, 8-amino, 8-thiol, 8-thioalkyl, 8-hydroxyl and other 8-substituted adenines and guanines, 5-halo particularly 5-bromo, 5-trifluoromethyl and other 5-substituted uracils and cytosines, 7-methylguanine and 7-methyladenine, 8-azaguanine and 8-azaadenine, 7-deazaguanine and 7-deazaadenine and 3-deazaguanine and 3-deazaadenine. Additional base modifications can be found, for example, in U.S. Pat. No. 3,687,808; Englisch et al. (1991) *Angewandie Chemie, International Edition* 30:613; and Sanghvi, Y. S., Chapter 15, Antisense Research and Applications, pages 289-302, Crooke, S. T. and Lebleu, B. ed., CRC Press, 1993, each of which is herein incorporated by reference in its entirety for all purposes. Certain nucleotide analogs, such as 5-substituted pyrimidines, 6-azapyrimidines and N-2, N-6 and 0-6 substituted purines, including 2-aminopropyladenine, 5-propynyluracil, 5-propynylcytosine, and 5-methylcytosine can increase the stability of duplex formation. Often base modifications can be combined with, for example, a sugar modification, such as 2'-O-methoxyethyl, to achieve unique properties such as increased duplex stability. There are numerous US patents, such as U.S. Pat. Nos. 4,845,205; 5,130,302; 5,134,066; 5,175,273; 5,367,066; 5,432,272; 5,457,187; 5,459,255; 5,484,908; 5,502,177; 5,525,711; 5,552,540; 5,587,469; 5,594,121, 5,596,091; 5,614,617; and 5,681,941, which detail and describe a range of base modifications. Each of these is herein incorporated by reference in its entirety for all purposes.

Nucleotide analogs can also include modifications of the sugar moiety. Modifications to the sugar moiety can include, for example, natural modifications of the ribose and deoxy ribose as well as synthetic modifications. Sugar modifications include, for example, the following modifications at the 2' position: OH; F; O—, S—, or N-alkyl; O—, S—, or N-alkenyl; O—, S—or N-alkynyl; or O-alkyl-O-alkyl, wherein the alkyl, alkenyl, and alkynyl may be substituted or unsubstituted C1 to C10, alkyl or C2 to C10 alkenyl and alkynyl. Exemplary 2' sugar modifications also include, for example, —O[(CH2)$_n$ O]m CH3, —O(CH2)$_n$OCH3, —O(CH2)$_n$ NH2, —O(CH2)$_n$ CH3, —O(CH2)$_n$—ONH2, and —O(CH2)$_n$ON[(CH2)$_n$CH3)]2, where n and m are from 1 to about 10.

Other modifications at the 2' position include, for example, $C_1$ to $C_{10}$ lower alkyl, substituted lower alkyl, alkaryl, aralkyl, O-alkaryl or O-aralkyl, SH, SCH3, OCN, Cl, Br, CN, CF3, $OCF_3$, SOCH3, $SO_2$ $CH_3$, $ONO_2$, $NO_2$, $N_3$, NH2, heterocycloalkyl, heterocycloalkaryl, aminoalkylamino, polyalkylamino, substituted silyl, an RNA cleaving group, a reporter group, an intercalator, a group for improving the pharmacokinetic properties of an oligonucleotide, or a group for improving the pharmacodynamic properties of an oligonucleotide, and other substituents having similar properties. Similar modifications may also be made at other positions on the sugar, particularly the 3' position of the sugar on the 3' terminal nucleotide or in 2'-5' linked oligonucleotides and the 5' position of 5' terminal nucleotide. Modified sugars can also include those that contain modifications at the bridging ring oxygen, such as $CH_2$ and S. Nucleotide sugar analogs may also have sugar mimetics such as cyclobutyl moieties in place of the pentofuranosyl sugar. There are numerous US patents that teach the preparation of such modified sugar structures such as U.S. Pat. Nos. 4,981,957; 5,118,800; 5,319,080; 5,359,044; 5,393,878; 5,446,137; 5,466,786; 5,514,785; 5,519,134; 5,567,811; 5,576,427; 5,591,722; 5,597,909; 5,610,300; 5,627,053; 5,639,873; 5,646,265; 5,658,873; 5,670,633; and 5,700,920, each of which is herein incorporated by reference in its entirety for all purposes.

Nucleotide analogs can also be modified at the phosphate moiety. Modified phosphate moieties include, for example, those that can be modified so that the linkage between two nucleotides contains a phosphorothioate, chiral phosphorothioate, phosphorodithioate, phosphotriester, aminoallylphosphotriester, methyl and other alkyl phosphonates including 3'-alkylene phosphonate and chiral phosphonates, phosphinates, phosphoramidates including 3'-amino phosphoramidate and aminoalkylphosphoramidates, thionophosphoramidates, thionoalkylphosphonates, thionoalkylphosphotriesters, and boranophosphates. These phosphate or modified phosphate linkage between two nucleotides can be through a 3'-5' linkage or a 2'-5' linkage, and the linkage can contain inverted polarity such as 3'-5' to 5'-3' or 2'-5' to 5'-2'. Various salts, mixed salts and free acid forms are also included. Numerous US patents teach how to make and use nucleotides containing modified phosphates and include, for example, U.S. Pat. Nos. 3,687,808; 4,469,863; 4,476,301; 5,023,243; 5,177,196; 5,188,897; 5,264,423; 5,276,019; 5,278,302; 5,286,717; 5,321,131; 5,399,676; 5,405,939; 5,453,496; 5,455,233; 5,466,677; 5,476,925; 5,519,126; 5,536,821; 5,541,306; 5,550,111; 5,563,253; 5,571,799; 5,587,361; and 5,625,050, each of which is herein incorporated by reference in its entirety for all purposes.

Nucleotide substitutes include molecules having similar functional properties to nucleotides, but which do not contain a phosphate moiety, such as peptide nucleic acid (PNA). Nucleotide substitutes include molecules that will recognize nucleic acids in a Watson-Crick or Hoogsteen manner, but which are linked together through a moiety other than a phosphate moiety. Nucleotide substitutes are able to conform to a double helix type structure when interacting with the appropriate target nucleic acid.

Nucleotide substitutes also include nucleotides or nucleotide analogs that have had the phosphate moiety or sugar moieties replaced. Nucleotide substitutes may not contain a standard phosphorus atom. Substitutes for the phosphate can be, for example, short chain alkyl or cycloalkyl internucleoside linkages, mixed heteroatom and alkyl or cycloalkyl internucleoside linkages, or one or more short chain heteroatomic or heterocyclic internucleoside linkages. These include those having morpholino linkages (formed in part from the sugar portion of a nucleoside); siloxane backbones; sulfide, sulfoxide and sulfone backbones; formacetyl and thioformacetyl backbones; methylene formacetyl and thioformacetyl backbones; alkene containing backbones; sulfamate backbones; methyleneimino and methylenehydrazino backbones; sulfonate and sulfonamide backbones; amide backbones; and others having mixed N, O, S and $CH_2$ component parts. Numerous US patents disclose how to make and use these types of phosphate replacements and include, but are not limited to, U.S. Pat. Nos. 5,034,506; 5,166,315; 5,185,444; 5,214,134; 5,216,141; 5,235,033; 5,264,562; 5,264,564; 5,405,938; 5,434,257; 5,466,677;

5,470,967; 5,489,677; 5,541,307; 5,561,225; 5,596,086; 5,602,240; 5,610,289; 5,602,240; 5,608,046; 5,610,289; 5,618,704; 5,623,070; 5,663,312; 5,633,360; 5,677,437; 5,677,439, each of which is herein incorporated by reference in its entirety for all purposes.

It is also understood in a nucleotide substitute that both the sugar and the phosphate moieties of the nucleotide can be replaced, by, for example, an amide type linkage (aminoethylglycine) (PNA). U.S. Pat. Nos. 5,539,082; 5,714,331; and 5,719,262 teach how to make and use PNA molecules, each of which is herein incorporated by reference in its entirety for all purposes. See also Nielsen et al. (1991) Science 254:1497-1500, herein incorporated by reference in its entirety for all purposes.

It is also possible to link other types of molecules (conjugates) to nucleotides or nucleotide analogs to enhance, for example, cellular uptake. Conjugates can be chemically linked to the nucleotide or nucleotide analogs. Such conjugates include, for example, lipid moieties such as a cholesterol moiety (Letsinger et al. (1989) *Proc. Nall. Acad. Sci. USA* 86:6553-6556, herein incorporated by reference in its entirety for all purposes), cholic acid (Manoharan et al. (1994) *Bioorg Med. Chem. Let.* 4:1053-1060, herein incorporated by reference in its entirety for all purposes), a thioether such as hexyl-S-tritylthiol (Manoharan et al. (1992) *Ann. N.Y. Acad. Sci.* 660:306-309; Manoharan et al. (1993) *Bioorg. Med. Chem. Let.* 3:2765-2770, herein incorporated by reference in its entirety for all purposes), a thiocholesterol (Oberhauser et al. (1992) *Nucl. Acids Res.* 20:533-538, herein incorporated by reference in its entirety for all purposes), an aliphatic chain such as dodecandiol or undecyl residues (Saison-Behmoaras et al. (1991) *EMBO J.* 10:1111-1118; Kabanov et al. (1990) *FEBS Lett.* 259:327-330, Svinarchuk et al. (1993) *Biochimie* 75:49-54, each of which is herein incorporated by reference in its entirety for all purposes), a phospholipid such as di-hexadecyl-rac-glycerol or triethylammonium 1,2-di-O-hexadecyl-rac-glycero-3-H-phosphonate (Manoharan et al. (1995) *Tetrahedron Lett.* 36:3651-3654; Shea et al. (1990) *Nucl. Acids Res.* 18:3777-3783, each of which is herein incorporated by reference in its entirety for all purposes), a polyamine or a polyethylene glycol chain (Manoharan et al. (1995) *Nucleosides & nucleotides* 14:969-973, herein incorporated by reference in its entirety for all purposes), or adamantane acetic acid (Manoharan et al. (1995) *Tetrahedron Lett.* 36:3651-3654, herein incorporated by reference in its entirety for all purposes), a palmityl moiety (Mishra et al. (1995) *Biochim. Biophys. Arta* 1264:229-237), or an octadecylamine or hexylamino-carbonyl-oxycholesterol moiety (Crooke et al. (1996) *J. Pharmacol. Exp. Ther.* 277:923-937, herein incorporated by reference in its entirety for all purposes). Numerous US patents teach the preparation of such conjugates and include, for example, U.S. Pat. Nos. 4,828,979; 4,948,882; 5,218,105; 5,525,465; 5,541,313; 5,545,730; 5,552,538; 5,578,717, 5,580,731; 5,580,731; 5,591,584; 5,109,124; 5,118,802; 5,138,045; 5,414,077; 5,486,603; 5,512,439; 5,578,718; 5,608,046; 4,587,044; 4,605,735; 4,667,025; 4,762,779; 4,789,737; 4,824,941; 4,835,263; 4,876,335; 4,904,582; 4,958,013; 5,082,830; 5,112,963; 5,214,136; 5,082,830; 5,112,963; 5,214,136; 5,245,022; 5,254,469; 5,258,506; 5,262,536; 5,272,250; 5,292,873; 5,317,098; 5,371,241, 5,391,723; 5,416,203, 5,451,463; 5,510,475; 5,512,667; 5,514,785; 5,565,552; 5,567,810; 5,574,142; 5,585,481; 5,587,371; 5,595,726; 5,597,696; 5,599,923; 5,599,928; 5,688,941, each of which is herein incorporated by reference in its entirety for all purposes.

The isolated nucleic acids disclosed herein can comprise a nucleotide sequence of a naturally occurring HSD17B13 gene or mRNA transcript, or can comprise a non-naturally occurring sequence. In one example, the non-naturally occurring sequence can differ from the non-naturally occurring sequence due to synonymous mutations or mutations that do not affect the encoded HSD17B13 protein. For example, the sequence can be identical with the exception of synonymous mutations or mutations that do not affect the encoded HSD17B13 protein. A synonymous mutation or substitution is the substitution of one nucleotide for another in an exon of a gene coding for a protein such that the produced amino acid sequence is not modified. This is possible because of the degeneracy of the genetic code, with some amino acids being coded for by more than one three-base pair codon. Synonymous substitutions are used, for example, in the process of codon optimization.

Also disclosed herein are proteins encoded by the nucleic acids disclosed herein and compositions comprising an isolated nucleic acid or protein disclosed herein and a carrier increasing the stability of the isolated nucleic acid or protein (e.g., prolonging the period under given conditions of storage (e.g., −20 °C, 4 °C, or ambient temperature) for which degradation products remain below a threshold, such below 0.5% by weight of the starting nucleic acid or protein; or increasing the stability in vivo). Non-limiting examples of such carriers include poly(lactic acid) (PLA) microspheres, poly(D,L-lactic-coglycolic-acid) (PLGA) microspheres, liposomes, micelles, inverse micelles, lipid cochleates, and lipid microtubules.

(1) Nucleic Acids Including Mutant Residue of HSD17B13 rs72613567 Variant

Disclosed herein are isolated nucleic acids comprising at least 15 contiguous nucleotides of an HSD17B13 gene and having a thymine at a position corresponding to position 12666 (or thymines at positions corresponding to positions 12666 and 12667) of the HSD17B13 rs72613567 variant (SEQ ID NO. 2) when optimally aligned with the HSD17B13 rs72613567 variant. That is, disclosed herein are isolated nucleic acids comprising at least 15 contiguous nucleotides of an HSD17B13 gene and having a thymine inserted between nucleotides corresponding to positions 12665 and 12666 of the wild type HSD17B13 gene (SEQ ID NO: 1) when optimally aligned with the wild type HSD17B13 gene. Such isolated nucleic acids can be useful, for example, to express HSD17B13 variant transcripts and proteins or as exogenous donor sequences. Such isolated nucleic acids can also be useful, for example, as guide RNAs, primers, and probes.

The HSD17B13 gene can be an HSD17B13 gene from any organism. For example, the HSD17B13 gene can be a human HSD17B13 gene or an ortholog from another organism, such as a non-human mammal, a rodent, a mouse, or a rat.

It is understood that gene sequences within a population can vary due to polymorphisms such as single-nucleotide polymorphisms. The examples provided herein are only exemplary sequences. Other sequences are also possible. As one example, the at least 15 contiguous nucleotides can be at least 90%, at least 95%, at least 96%, at least 97%, at least 98%, or at least 99% identical to a corresponding sequence in the HSD17B13 rs72613567 variant (SEQ ID NO: 2) including position 12666 or positions 12666 and 12667 of SEQ ID NO: 2 when optimally aligned with SEQ ID NO: 2. Optionally, the isolated nucleic acid comprises at least 15 contiguous nucleotides of SEQ ID NO: 2 including position 12666 or positions 12666 and 12667 of SEQ ID NO: 2. As another example, the at least 15 contiguous nucleotides can be at least 90%, at least 95%, at least 96%, at least 97%, at least 98%, or at least 99% identical to a corresponding sequence in the wild type HSD17B13 gene (SEQ ID NO: 1) including positions 12665 and 12666 of SEQ ID NO: 1 when optimally aligned with SEQ ID NO: 1, wherein a thymine is present between the positions corresponding to positions 12665 and 12666 of SEQ ID NO: 1. Optionally, the isolated nucleic acid comprises at least 15 contiguous nucleotides of SEQ ID NO: 1 including positions 12665 and 12666 of SEQ ID NO: 1, wherein a thymine is present between the positions corresponding to positions 12665 and 12666 of SEQ ID NO: 1.

The isolated nucleic acid can comprise, for example, at least 20, 25, 30, 35, 40, 45, 50, 60, 70, 80, 90, 100, 200, 300, 400, 500, 600, 700, 800, 900, or 1000 contiguous nucleotides of an HSD17B13 gene. Alternatively, the isolated nucleic acid can comprise, for example, at least 1000, 2000, 3000, 4000, 5000, 6000, 7000, 8000, 9000, 10000, 11000, 12000, 13000, 14000, 15000, 16000, 17000, 18000, or 19000 contiguous nucleotides of an HSD17B13 gene.

In some cases, the isolated nucleic acid can comprise an HSD17B13 minigene in which one or more nonessential segments of the gene have been deleted with respect to a corresponding wild type HSD17B13 gene. As one example, the deleted segments comprise one or more intronic sequences. Such HSD17B13 minigenes can comprise, for example, exons corresponding to exons 1-7 from HSD17B13 Transcript D and an intron corresponding to intron 6 in SEQ ID NO: 2 when optimally aligned with SEQ ID NO: 2. As one example, an HSD17B13 minigene may comprise exons 1-7 and intron 6 from SEQ ID NO: 2. Minigenes are described in more detail elsewhere herein.

(2) Nucleic Acids Hybridizing to Sequence Adjacent to or Including Mutant Residue of HSD17B13 rs72613567 Variant Also disclosed herein are isolated nucleic acids comprising at least 15 contiguous nucleotides that hybridize to an HSD17B13 gene (e.g., an HSD17B13 minigene) at a segment that includes or is within 1000, 500, 400, 300, 200, 100, 50, 45, 40, 35, 30, 25, 20, 15, 10, or 5 nucleotides of a position corresponding to position 12666 or positions 12666 and 12667 of the HSD17B13 rs72613567 variant (SEQ ID NO: 2) when optimally aligned with the HSD17B13 rs72613567 variant. Such isolated nucleic acids can be useful, for example, as guide RNAs, primers, probes, or exogenous donor sequences.

The HSD17B13 gene can be an HSD17B13 gene from any organism. For example, the HSD17B13 gene can be a human HSD17B13 gene or an ortholog from another organism, such as a non-human mammal, a mouse, or a rat.

As one example, the at least 15 contiguous nucleotides can hybridize to a segment of the HSD17B13 gene or HSD17B13 minigene that is at least 90%, at least 95%, at least 96%, at least 97%, at least 98%, or at least 99% identical to a corresponding sequence in the HSD17B13 rs72613567 variant (SEQ ID NO: 2) when optimally aligned with SEQ ID NO: 2. Optionally, the isolated nucleic acid can hybridize to at least 15 contiguous nucleotides of SEQ ID NO: 2. Optionally, the isolated nucleic acid hybridizes to a segment including position 12666 or positions 12666 and 12667 in SEQ ID NO: 2 or a position corresponding to position 12666 or positions 12666 and 12667 in SEQ ID NO: 2 when optimally aligned with SEQ ID NO: 2.

The segment to which the isolated nucleic acid can hybridize can comprise, for example, at least 20, 25, 30, 35, 40, 45, 50, 55, 60, 65, 70, 75, 80, 75, 90, 95, 100, 200, 300, 400, 500, 600, 700, 800, 900, or 1000 contiguous nucleotides of an HSD17B13 gene. Alternatively, the isolated nucleic acid can comprise, for example, at least 1000, 2000, 3000, 4000, 5000, 6000, 7000, 8000, 9000, 10000, 11000, 12000, 13000, 14000, 15000, 16000, 17000, 18000, or 19000 contiguous nucleotides of an HSD17B13 gene. Alternatively, the segment to which the isolated nucleic acid can hybridize can be, for example, up to 20, 25, 30, 35, 40, 45, 50, 55, 60, 65, 70, 75, 80, 75, 90, 95, 100, 200, 300, 400, 500, 600, 700, 800, 900, or 1000 contiguous nucleotides of an HSD17B13 gene. For example, the segment can be about 15 to 100 nucleotides in length, or about 15-35 nucleotides in length.

(3) cDNAs and Variant Transcripts Produced by HSD17B13 rs72613567 Variant

Also provided are nucleic acids corresponding to all or part of an mRNA transcript or a cDNA corresponding to any one of Transcripts A-H (SEQ ID NOS: 4-11, respectively), and particularly Transcripts C-H, when optimally aligned with the any one of Transcripts A-H. It is understood that gene sequences and within a population and mRNA sequences transcribed from such genes can vary due to polymorphisms such as single-nucleotide polymorphisms. The sequences provided herein for each Transcript are only exemplary sequences. Other sequences are also possible. Specific, non-limiting examples are provided below. Such isolated nucleic acids can be useful, for example, to express HSD17B13 variant transcripts and proteins.

The isolated nucleic acid can be of any length. For example, the isolated nucleic acid can comprise at least 10, 15, 20, 25, 30, 35, 40, 45, 50, 60, 70, 80, 90, 100, 200, 300, 400, 500, 600, 700, 800, 900, 1000, or 2000 contiguous nucleotides encoding all or part of an HSD17B13 protein. In some cases, the isolated nucleic acids comprises contiguous nucleotides encoding all or part of an HSD17B13 protein, wherein the contiguous nucleotides comprise sequence from at least two different exons of an HSD17B13 gene (e.g., spanning at least one exon-exon boundary of an HSD17B13 gene without an intervening intron).

HSD17B13 Transcript D (SEQ ID NO: 7), Transcript G (SEQ ID NO: 10), and Transcript H (SEQ ID NO: 11) include an insertion of a guanine at the 3' end of exon 6, resulting in a frameshift in exon 7 and premature truncation of the region of the HSD17B13 protein encoded by exon 7 compared to Transcript A. Accordingly, provided herein are isolated nucleic acids comprising a segment (e.g., at least 15 contiguous nucleotides) present in Transcripts D, G, and H (or fragments or homologs thereof) that is not present in Transcript A (or a fragment or homolog thereof). Such regions can be readily identified by comparing the sequences of the Transcripts. For example, provided herein are isolated nucleic acids comprising at least 15 contiguous nucleotides (e.g., at least 20 contiguous nucleotides or at least 30 contiguous nucleotides) encoding all or part of an HSD17B13 protein, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region spanning the exon 6-exon 7 boundary in SEQ ID NO: 7 (HSD17B13 Transcript D), SEQ ID NO: 10 (HSD17B13 Transcript G), or SEQ ID NO: 11 (HSD17B13 Transcript H) when optimally aligned with SEQ ID NO: 7, 10, or 11, respectively, and the segment includes a guanine at a residue corresponding to residue 878 at the 3' end of exon 6 in SEQ ID NO: 7 (i.e., an insertion of a guanine at the 3' end of exon 6 relative to Transcript A in addition to the guanine at the start of exon 7), a residue corresponding to residue 770 at the 3' end of exon 6 in SEQ ID NO: 10 (i.e., an insertion of a guanine at the 3' end of exon 6 relative to Transcript B in addition to the guanine at the start of exon 7), or a residue corresponding to residue 950 at the 3' end of exon 6 in SEQ ID NO: 11 (i.e., an insertion of a guanine at the 3' end of exon 6 relative to Transcript E in addition to the guanine at the start of exon 7). It is understood that such a nucleic acid would include a sufficient number of nucleotides in each of exons 6 and 7 to distinguish the inserted guanine from other features in the HSD17B13 Transcripts (e.g., from the guanine at the start of exon 7, from the read-through into intron 6 in Transcript F, or from the deleted exon 6 in Transcript C).

As one example, the isolated nucleic acid can comprise at least 15 contiguous nucleotides (e.g., at least 20 contiguous nucleotides or at least 30 contiguous nucleotides) of SEQ ID NO: 7 spanning the exon 6-exon 7 boundary, optionally comprising exons 6 and 7 of SEQ ID NO: 7, and optionally comprising the entire sequence of SEQ ID NO: 7.

Optionally, the isolated nucleic acid further comprises a segment present in Transcript D (or a fragment or homolog thereof) that is not present in Transcript G (or a fragment or homolog thereof), and the isolated nucleic acid further comprises a segment present in Transcript D (or a fragment or homolog thereof) that is not present in Transcript H (or a fragment or homolog thereof). Such regions can be readily identified by comparing the sequences of the Transcripts. For example, such isolated nucleic acids can comprise a segment of the contiguous nucleotides (e.g., at least 5 contiguous nucleotides, at least 10 contiguous nucleotides or at least 15 contiguous nucleotides) that is at least 90%, at least 95%, at least 96%, at least 97%, at least 98%, or at least 99% identical to a region spanning the boundary of exons 3 and 4 of SEQ ID NO: 7 (HSD17B13 Transcript D) when optimally aligned with SEQ ID NO: 7 to distinguish from Transcript H. Likewise, such isolated nucleic acids can comprise a segment of the contiguous nucleotides (e.g., at least 5 contiguous nucleotides, at least 10 contiguous nucleotides or at least 15 contiguous nucleotides) that is at least 90%, at least 95%, at least 96%, at least 97%, at least 98%, or at least 99% identical to a region within exon 2 of SEQ ID NO: 7 (HSD17B13 Transcript D), a region spanning the exon 1-exon 2 boundary of SEQ ID NO: 7, or a region spanning the exon 2-exon 3 boundary of SEQ CD NO: 7 when optimally aligned with SEQ ID NO: 7 to distinguish from Transcript G. Optionally, the isolated nucleic acid comprises a sequence at least 90%, at least 95%, at least 96%, at least 97%, at least 98%, or at least 99% identical to the sequence set forth in SEQ ID NO: 7 (HSD17B13 Transcript D) and encodes an HSD17B13 protein comprising the sequence set forth in SEQ ID NO: 15 (HSD17B13 Isoform D).Like Transcript D, Transcript H (SEQ ID NO: 11) includes an insertion of a guanine 3' of exon 6 compared to Transcript A. Transcript H further includes an additional exon (exon 3') between exons 3 and 4 compared to Transcript A and Transcript D. Accordingly, provided herein are isolated nucleic acids as described for above comprising a segment present in Transcripts D, G, and H (or fragments or homologs thereof) that is not present in Transcript A (or a fragment or homolog thereof) but further comprising a segment (e.g., at least 15 contiguous nucleotides) of Transcript H (or a fragment or homolog thereof) that is not present in Transcript D (or a fragment or homolog thereof). Such regions can be readily identified by comparing the sequences of the Transcripts. For example, provided herein are isolated nucleic acids as described for Transcript D, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region within exon 3' of SEQ ID NO: 11 (HSD17B13 Transcript H), a region spanning the exon 3-exon 3' boundary of SEQ ID NO: 11, or a region spanning the exon 3'-exon 4 boundary of SEQ ID NO: 11 when optimally aligned with SEQ ID NO: 11. It is understood that such a nucleic acid would include a sufficient number of nucleotides in each of exons 3 and 3' or each of exons 3' and 4 to distinguish from other features in the HSD17B13 transcripts (e.g., from the boundary of exons 3 and 4). For example, the region of exon 3' can comprise the entire exon 3'. Optionally, the isolated nucleic acid comprises a sequence at least 90%, at least 95%, at least 96%, at least 97%, at least 98%, or at least 99% identical to the sequence set forth in SEQ ID NO: 11 (HSD17B13 Transcript H) and encodes an HSD17B13 protein comprising the sequence set forth in SEQ ID NO: 19 (HSD17B13 Isoform H).

As one example, the isolated nucleic acid can comprise at least 15 contiguous nucleotides (e.g., at least 20 contiguous nucleotides or at least 30 contiguous nucleotides) of SEQ ID NO: 11 including a region within exon 3', a region spanning the exon 3-exon 3' boundary, or a region spanning the exon 3'-exon 4 boundary, optionally comprising the entire exon 3' of SEQ ID NO: 11, and optionally comprising the entire sequence of SEQ ID NO: 11.

Like Transcript D, Transcript G (SEQ ID NO: 10) includes an insertion of a guanine 3' of exon 6 compared to Transcript A. In addition, however, Transcript G is missing exon 2 compared to Transcript A and Transcript D (i.e., Transcript G includes an exon 1-exon 3 boundary not present in Transcripts A and D). Accordingly, provided herein are isolated nucleic acids as described above comprising a segment present in Transcripts D, G, and H (or fragments or homologs thereof) that is not present in Transcript A (or a fragment or homolog thereof) but further comprising a segment (e.g., at least 15 contiguous nucleotides) from Transcript G (or a fragment or homolog thereof) that is not present in Transcript D (or a fragment or homolog thereof). Such regions can be readily identified by comparing the sequences of the Transcripts. For example, provided herein are isolated nucleic acids as described for Transcript D, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region spanning the exon 1-exon 3 boundary in SEQ ID NO: 10 (HSD17B13 Transcript G) when optimally aligned with SEQ ID NO: 10. It is understood that such a nucleic acid would include a sufficient number of nucleotides in each of exons 1 and 3 to distinguish from other features in the HSD17B13 Transcripts (e.g., the boundary of exons 1 and 2 or the boundary of exons 2 and 3). For example, the region can comprise the entirety of exons 1 and 3 in SEQ ID NO: 10. Optionally, the isolated nucleic acid comprises a sequence at least 90%, at least 95%, at least 96%, at least 97%, at least 98%, or at least 99% identical to the sequence set forth in SEQ ID NO: 10 (HSD17B13 Transcript G) and encodes an HSD17B13 protein comprising the sequence set forth in SEQ ID NO: 18 (HSD17B 13 Isoform G).

As one example, the isolated nucleic acid can comprise at least 15 contiguous nucleotides (e.g., at least 20 contiguous nucleotides or at least 30 contiguous nucleotides) of SEQ ID NO: 10 including a region spanning the exon 1-exon 3 boundary, optionally comprising the exons 1 and 3 of SEQ ID NO: 10, and optionally comprising the entire sequence of SEQ ID NO: 10.

Also provided herein are isolated nucleic acids comprising a segment (e.g., at least 15 contiguous nucleotides) present in Transcript E (or a fragment or homolog thereof) that is not present in Transcript A (or a fragment or homolog thereof). Such regions can be readily identified by comparing the sequences of the Transcripts. Transcript E (SEQ ID NO: 8) includes an additional exon between exons 3 and 4 compared to Transcript A. Accordingly, provided herein are isolated nucleic acids comprising at least 15 contiguous nucleotides (e.g., at least 20 contiguous nucleotides or at least 30 contiguous nucleotides) encoding all or part of an HSD17B13 protein, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region within exon 3' of SEQ ID NO: 8 (HSD17B13 Transcript E), a region spanning the exon 3-exon 3' boundary of SEQ ID NO: 8, or a region spanning the exon 3'-exon 4 boundary of SEQ ID NO: 8 when optimally aligned with SEQ ID NO: 8. It is understood that such a nucleic acid would include a sufficient number of nucleotides in each of exons 3 and 3' or each of exons 3' and 4 to distinguish from other features in the HSD17B13 transcripts (e.g., from the boundary of exons 3 and 4). For example, the region of exon 3' can comprise the entire exon 3'. Optionally, the isolated nucleic acid further comprises a segment (e.g., at least 15 contiguous nucleotides) from Transcript E (or a fragment or homolog thereof) that is not present in Transcript H (or a fragment or homolog thereof). Such regions can be readily identified by comparing the sequences of the Transcripts. For example, provided herein are isolated nucleic acids as described above, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region spanning the exon 6-exon 7 boundary in SEQ ID NO: 8 (HSD17B13 Transcript E) when optimally aligned with SEQ ID NO: 8. It is understood that such a nucleic acid would include a sufficient number of nucleotides in each of exons 6 and 7 to distinguish from other features in the HSD17B13 Transcripts (particularly the additional guanine at the 3' end of exon 6 in Transcript H)). For example, the region can comprise the entirety of exons 6 and 7 in SEQ ID NO: 8. Optionally, the isolated nucleic acid comprises a sequence at least 90%, at least 95%, at least 96%, at least 97%, at least 98%, or at least 99% identical to the sequence set forth in SEQ ID NO: 8 (HSD17B13 Transcript E) and encodes an HSD17B13 protein comprising the sequence set forth in SEQ ID NO: 16 (HSD17B13 Isoform E).

As one example, the isolated nucleic acid can comprise at least 15 contiguous nucleotides (e.g., at least 20 contiguous nucleotides or at least 30 contiguous nucleotides) of SEQ ID NO: 8 including a region within exon 3', a region spanning the exon 3-exon 3' boundary, or a region spanning the exon 3'-exon 4 boundary, optionally comprising the entire exon 3' of SEQ ID NO: 8, and optionally comprising the entire sequence of SEQ ID NO: 8.

Also provided herein are isolated nucleic acids comprising a segment (e.g., at least 15 contiguous nucleotides) present in Transcript F (or a fragment or homolog thereof) that is not present in Transcript A (or a fragment or homolog thereof). Such regions can be readily identified by comparing the sequences of the Transcripts. Transcript F (SEQ ID NO: 9) includes a read-through from exon 6 into intron 6 compared to Transcript A, and the read-through includes the inserted thymine present in the HSD17B13 rs72613567 variant gene. Accordingly, provided herein are isolated nucleic acids comprising at least 15 contiguous nucleotides (e.g., at least 20 contiguous nucleotides or at least 30 contiguous nucleotides) encoding all or part of an HSD17B13 protein, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region within the read-through into intron 6 in SEQ ID NO: 9 (HSD17B13 Transcript F) or a region spanning the boundary between the read-through into intron 6 and the rest of exon 6 in SEQ ID NO: 9 when optimally aligned with SEQ ID NO: 9. It is understood that such a nucleic acid would a sufficient number of nucleotides in the read-through to distinguish the read-through from other features in the HSD17B13 Transcripts (e.g., from boundary of exons 6 and 7 in other HSD17B13 Transcripts). Optionally, the contiguous nucleotides comprise a sequence present in Transcript F (i.e., the inserted thymine) that is not present in Transcript F' (SEQ II) NO: 246). Transcript F' also includes a read-through from exon 6 into intron 6 compared to Transcript A, but the read-through does not include the inserted thymine present in the HSD17B13 rs72613567 variant gene. For example, the region can be the entire read-through into intron 6 in SEQ ID NO: 9. Optionally, the isolated nucleic acid comprises a sequence at least 90%, at least 95%, at least 96%, at least 97%, at least 98%, or at least 99% identical to the sequence set forth in SEQ ID NO: 9 (HSD17B13 Transcript F) and encodes an HSD17B13 protein comprising the sequence set forth in SEQ ID NO: 17 (HSD17B13 Isoform F).

As one example, the isolated nucleic acid can comprise at least 15 contiguous nucleotides (e.g., at least 20 contiguous nucleotides or at least 30 contiguous nucleotides) of SEQ ID NO: 9 including a region within the read-through into intron 6 or a region spanning the boundary between the read-through into intron 6 and the rest of exon 6, optionally comprising the entire read-through into intron 6, and optionally comprising the entire sequence of SEQ ID NO: 9.

Also provided herein are isolated nucleic acids comprising a segment (e.g., at least 15 contiguous nucleotides) present in Transcript F' (or a fragment or homolog thereof) that is not present in Transcript A (or a fragment or homolog thereof). Such regions can be readily identified by comparing the sequences of the Transcripts. Transcript F' (SEQ ID NO: 246) includes a read-through from exon 6 into intron 6 compared to Transcript A, and the read-through does not include the inserted thymine present in the HSD17B13 rs72613567 variant gene. Accordingly, provided herein are isolated nucleic acids comprising at least 15 contiguous nucleotides (e.g., at least 20 contiguous nucleotides or at least 30 contiguous nucleotides) encoding all or part of an HSD17B13 protein, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region within the read-through into intron 6 in SEQ ID NO: 246 (HSD17B13 Transcript F') or a region spanning the boundary between the read-through into intron 6 and the rest of exon 6 in SEQ ID NO: 246 when optimally aligned with SEQ ID NO: 246. It is understood that such a nucleic acid would a sufficient number of nucleotides in the read-through to distinguish the read-through from other features in the HSD17B13 Transcripts (e.g., from boundary of exons 6 and 7 in other HSD17B13 Transcripts). Optionally, the contiguous nucleotides comprise a sequence present in Transcript F' that is not present in Transcript F (SEQ ID NO: 9). The read-through in Transcript F includes the inserted thymine present in the HSD17B13 rs72613567 variant gene, whereas the read-through in Transcript F' does not. For example, the region can be the entire read-through into intron 6 in SEQ ID NO: 246. Optionally, the isolated nucleic acid comprises a sequence at least 90%, at least 95%, at least 96%, at least 97%, at least 98%, or at least 99% identical to the sequence set forth in SEQ ID NO: 246 (HSD17B13 Transcript F') and encodes an HSD17B13 protein comprising, consisting essentially of, or consisting of the sequence set forth in SEQ ID NO: 247 (HSD17B13 Isoform F').

As one example, the isolated nucleic acid can comprise at least 15 contiguous nucleotides (e.g., at least 20 contiguous nucleotides or at least 30 contiguous nucleotides) of SEQ ID NO: 246 including a region within the read-through into intron 6 or a region spanning the boundary between the read-through into intron 6 and the rest of exon 6, optionally comprising the entire read-through into intron 6, and optionally comprising the entire sequence of SEQ ID NO: 246.

Also provided herein are isolated nucleic acids comprising a segment (e.g., at least 15 contiguous nucleotides) present in Transcript C (or a fragment or homolog thereof) that is not present in Transcript A (or a fragment or homolog thereof). Such regions can be readily identified by comparing the sequences of the Transcripts. Transcript C (SEQ ID NO: 6) is missing exon 6 compared to Transcript A (i.e., Transcript C includes an exon 5-exon 7 boundary not present in Transcript A). Accordingly, provided herein are isolated nucleic acids comprising at least 15 contiguous nucleotides (e.g., at least 20 contiguous nucleotides or at least 30 contiguous nucleotides) encoding all or part of an HSD17B13 protein, wherein a segment of the contiguous nucleotides (e.g., at least 5 contiguous nucleotides, at least 10 contiguous nucleotides or at least 15 contiguous nucleotides) is at least 90%, at least 95%, at least 96%, at least 97%, at least 98%, or at least 99% identical to a region spanning the exon 5-exon 7 boundary in SEQ ID NO: 6 (HSD17B13 Transcript C) when optimally aligned with SEQ ID NO: 6. It is understood that such a nucleic acid would a sufficient number of nucleotides in each of exons 5 and 7 to distinguish from other features in the HSD17B13 Transcripts (e.g., from boundary of exons 5 and 6 or of exons 6 and 7 in other HSD17B13 Transcripts). For example, the region can comprise the entirety of exons 5 and 7 in SEQ ID NO: 6. Optionally, the isolated nucleic acid comprises a sequence at least 90%, at least 95%, at least 96%, at least 97%, at least 98%, or at least 99% identical to the sequence set forth in SEQ ID NO: 6 (HSD17B13 Transcript C) and encodes an HSD17B13 protein comprising the sequence set forth in SEQ ID NO: 14 (HSD17B13 Isoform C).

As one example, the isolated nucleic acid can comprise at least 15 contiguous nucleotides (e.g., at least 20 contiguous nucleotides or at least 30 contiguous nucleotides) of SEQ ID NO: 6 including a region spanning the exon 5-exon 7 boundary, optionally comprising the entirety of exons 5 and 7 in SEQ ID NO: 6, and optionally comprising the entire sequence of SEQ ID NO: 6.

(4) Nucleic Acids Hybridizing to cDNAs and Variant HSD17B13 Transcripts

Also provided are nucleic acids hybridizing to segments of an mRNA transcript or a cDNA corresponding to any one of Transcripts A-H (SEQ ID NOS: 4-11, respectively), and particularly Transcripts C-H, when optimally aligned with the any one of Transcripts A-H. Specific, non-limiting examples are provided below. Such isolated nucleic acids can be useful, for example, primers, probes, antisense RNAs, siRNAs, or shRNAs.

The segment to which the isolated nucleic acid can hybridize can comprise, for example, at least 5, at least 10, or at least 15 contiguous nucleotides of a nucleic acid encoding an HSD17B13 protein. The segment to which the isolated nucleic acid can hybridize can comprise, for example, at least 20, 25, 30, 35, 40, 45, 50, 55, 60, 65, 70, 75, 80, 75, 90, 95, 100, 200, 300, 400, 500, 600, 700, 800, 900, 1000, or 2000 contiguous nucleotides of a nucleic acid encoding an HSD17B13 protein. Alternatively, the segment to which the isolated nucleic acid can hybridize can be, for example, up to 20, 25, 30, 35, 40, 45, 50, 55, 60, 65, 70, 75, 80, 75, 90, 95, 100, 200, 300, 400, 500, 600, 700, 800, 900, or 1000 contiguous nucleotides of a nucleic acid encoding an HSD17B13 protein. For example, the segment can be about 15 to 100 nucleotides in length, or about 15-35 nucleotides in length.

HSD17B13 Transcript D (SEQ ID NO: 7), Transcript G (SEQ ID NO: 10), and Transcript H (SEQ ID NO: 11) include an insertion of a guanine at the 3' end of exon 6, resulting in a frameshift in and premature truncation of exon 7 compared to Transcript A. Accordingly, provided herein are isolated nucleic acids comprising a region (e.g., at least 15 contiguous nucleotides) that hybridizes to a segment present in Transcripts D, G, and H (or fragments or homologs thereof) that is not present in Transcript A (or a fragment or homolog thereof). Such regions can be readily identified by comparing the sequences of the Transcripts. For example, provided herein are isolated nucleic acids that hybridize to at least 15 contiguous nucleotides of a nucleic acid encoding an HSD17B13 protein, wherein contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 6-exon 7 boundary in SEQ ID NO: 7 (HSD17B13 Transcript D) when optimally aligned with SEQ ID NO: 7, and the segment includes a guanine at a residue corresponding to residue 878 at the 3' end of exon 6 in SEQ ID NO: 7 (i.e., an insertion of a guanine at the 3' end of exon 6 relative to Transcript A in addition to the guanine at the start of exon 7). Alternatively, provided herein are isolated nucleic acids that hybridize to at least 15 contiguous nucleotides of a segment of a nucleic acid encoding an HSD17B13 protein, wherein the contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 6-exon 7 boundary in SEQ ID NO: 10 (HSD17B13 Transcript G) when optimally aligned with SEQ ID NO: 10, and the segment includes a guanine at a residue corresponding to residue 770 at the 3' end of exon 6 in SEQ ID NO: 10 (i.e., an insertion of a guanine at the 3' end of exon 6 relative to Transcript B in addition to the guanine at the start of exon 7). Alternatively, provided herein are isolated nucleic acids comprising that hybridize to at least 15 contiguous nucleotides of a nucleic acid encoding an HSD17B13 protein, wherein the contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 6-exon 7 boundary in SEQ ID NO: 11 (HSD17B13 Transcript H) when optimally aligned with SEQ ID NO: 11, and the segment includes a guanine at a residue corresponding to residue 950 at the 3' end of exon 6 in SEQ ID NO: 11 (i.e., an insertion of a guanine at the 3' end of exon 6 relative to Transcript E in addition to the guanine at the start of exon 7). It is understood that such nucleic acids would be designed to hybridize to a sufficient number of nucleotides in each of exons 6 and 7 to distinguish the inserted guanine from other features in the HSD17B13 Transcripts (e.g., from the read-through into intron 6 in Transcript F or from the deleted exon 6 in Transcript C).

As one example, the segment can comprise a region of SEQ ID NO: 7 spanning the exon 6-exon 7 boundary (i.e., including the guanine at residue 878 of SEQ ID NO: 7). As another example, the segment can comprise a region of SEQ ID NO: 10 spanning the exon 6-exon 7 boundary (i.e., including the guanine at residue 770 of SEQ ID NO: 10). As another example, the segment can comprise a region of SEQ ID NO: 11 spanning the exon 6-exon 7 boundary (i.e., including the guanine at residue 950 of SEQ ID NO: 11).

Optionally, the isolated nucleic acid further comprises a region (e.g., 15 contiguous nucleotides) that hybridizes to a segment present in Transcript D (or a fragment or homolog thereof) that is not present in Transcript G (or a fragment or homolog thereof), and the isolated nucleic acid further comprises a region that hybridizes to a segment present in Transcript D (or a fragment or homolog thereof) that is not present in Transcript H (or a fragment or homolog thereof). Such segments can be readily identified by comparing the sequences of the Transcripts. For example, the segment (e.g., at least 5 contiguous nucleotides, at least 10 contiguous nucleotides or at least 15 contiguous nucleotides) present in Transcript D (or a fragment or homolog thereof) that is not present in Transcript H (or a fragment or homolog thereof) can be at least 90%, at least 95%, at least 96%, at least 97%, at least 98%, or at least 99% identical to a region spanning the boundary of exons 3 and 4 of SEQ ID NO: 7 (HSD17B13 Transcript D) when optimally aligned with SEQ ID NO: 7 to distinguish from Transcript H. Likewise, the segment (e.g., at least 5 contiguous nucleotides, at least 10 contiguous nucleotides or at least 15 contiguous nucleotides) present in Transcript D (or a fragment or homolog thereof) that is not present in Transcript G (or a fragment or homolog thereof) can be at least 90%, at least 95%, at least 96%, at least 97%, at least 98%, or at least 99% identical to a region within exon 2 of SEQ ID NO: 7 (HSD17B13 Transcript D), a region spanning the exon 1-exon 2 boundary of SEQ ID NO: 7, or a region spanning the exon 2-exon 3 boundary of SEQ ID NO: 7 when optimally aligned with SEQ ID NO: 7 to distinguish from Transcript G.

Like Transcript D, Transcript H (SEQ ID NO: 11) includes an insertion of a guanine at the 3' end of exon 6 compared to Transcript A. Transcript H further includes an additional exon between exons 3 and 4 compared to Transcript A and Transcript D. Accordingly, provided herein are isolated nucleic acids as described above comprising a region that hybridizes to a segment present in Transcripts D, G, and H (or fragments or homologs thereof) that is not present in Transcript A (or a fragment or homolog thereof) but further comprising a region (e.g., at least 15 contiguous nucleotides) that hybridizes to a segment that is present in Transcript H (or a fragment or homolog thereof) but not in Transcript D (or a fragment or homolog thereof). Such regions can be readily identified by comparing the sequences of the Transcripts. For example, the segment can be at least 90%, at least 95%, at least 96%, at least 97%, at least 98%, at least 99%, or 100% identical to a region (e.g., at least 5 contiguous nucleotides, at least 10 contiguous nucleotides or at least 15 contiguous nucleotides) within exon 3' of SEQ ID NO: 11 (HSD17B13 Transcript H), a region spanning the exon 3-exon 3' boundary of SEQ ID NO: 11, or a region spanning the exon 3'-exon 4 boundary of SEQ ID NO: 11 when optimally aligned with SEQ ID NO: 11. It is understood that such a nucleic acid would be designed to hybridize to a sufficient number of nucleotides in each of exons 3 and 3' or each of exons 3' and 4 to distinguish from other features in the HSD17B13 transcripts (e.g., from the boundary of exons 3 and 4).

As one example, the segment can comprise a region of SEQ ID NO: 11 within exon 3', spanning the exon 3-exon 3' boundary, or spanning the exon 3'-exon 4 boundary.

Like Transcript D, Transcript G (SEQ ID NO: 10) includes an insertion of a guanine at the 3' end of exon 6 compared to Transcript A. In addition, however, Transcript G is missing exon 2 compared to Transcript A and Transcript D (i.e., Transcript G includes an exon 1-exon 3 boundary not present in Transcripts A and D). Accordingly, provided herein are isolated nucleic acids as described above comprising a region that hybridizes to a segment present in Transcripts D, G, and H (or fragments or homologs thereof) that is not present in Transcript A (or a fragment or homolog thereof) but further comprising a region (e.g., at least 15 contiguous nucleotides) that hybridizes to a segment present in Transcript G (or a fragment or homolog thereof) but not in Transcript D (or a fragment or homolog thereof). Such regions can be readily identified by comparing the sequences of the Transcripts. For example, the segment can be at least 90%, at least 95%, at least 96%, at least 97%, at least 98%, at least 99%, or 100% identical to a region (e.g., at least 5 contiguous nucleotides, at least 10 contiguous nucleotides or at least 15 contiguous nucleotides) spanning the exon 1-exon 3 boundary in SEQ ID NO: 10 (HSD17B13 Transcript G) when optimally aligned with SEQ ID NO: 10. It is understood that such a nucleic acid would be designed to hybridize to a sufficient number of nucleotides in each of exons 1 and 3 to distinguish from other features in the HSD17B13 Transcripts (e.g., the boundary of exons 1 and 2 or the boundary of exons 2 and 3).

As one example, the segment can comprise a region of SEQ ID NO: 10 spanning the exon 1-exon 3 boundary.

Also provided are isolated nucleic acids comprising a region (e.g., at least 15 contiguous nucleotides) that hybridizes to a segment of a nucleic acid encoding an HSD17B13 protein that is present in Transcript E (or a fragment or homolog thereof) but not in Transcript A (or a fragment or homolog thereof). Such regions can be readily identified by comparing the sequences of the Transcripts. Transcript E (SEQ ID NO: 8) includes an additional exon between exons 3 and 4 compared to Transcript A. Accordingly, provided herein are isolated nucleic acids that hybridize to at least 15 contiguous nucleotides of a nucleic acid encoding an HSD17B13 protein, wherein the contiguous nucleotides comprise a segment that is at least 90%, at least 95%, at least 96%, at least 97%, at least 98%, at least 99%, or 100% identical to a region (e.g., at least 5 contiguous nucleotides, at least 10 contiguous nucleotides or at least 15 contiguous nucleotides) within exon 3' of SEQ ID NO: 8 (HSD17B13

Transcript E), a region spanning the exon 3-exon 3' boundary of SEQ ID NO: 8, or a region spanning the exon 3'-exon 4 boundary of SEQ ID NO: 8 when optimally aligned with SEQ ID NO: 8. It is understood that such a nucleic acid would be designed to hybridize to a sufficient number of nucleotides in each of exons 3 and 3' or each of exons 3' and 4 to distinguish from other features in the HSD17B13 transcripts (e.g., from the boundary of exons 3 and 4).

As one example, the segment can comprise a region of SEQ ID NO: 8 within exon 3', spanning the exon 3-exon 3' boundary of SEQ ID NO: 8, or spanning the exon 3'-exon 4 boundary.

Optionally, the isolated nucleic acid further comprises a region (e.g., 15 contiguous nucleotides) that hybridizes to a segment present in Transcript E (or a fragment or homolog thereof) that is not present in Transcript H (or a fragment or homolog thereof). Such segments can be readily identified by comparing the sequences of the Transcripts. For example, the segment (e.g., at least 5 contiguous nucleotides, at least 10 contiguous nucleotides or at least 15 contiguous nucleotides) present in Transcript E (or a fragment or homolog thereof) that is not present in Transcript H (or a fragment or homolog thereof) can be at least 90%, at least 95%, at least 96%, at least 97%, at least 98%, or at least 99% identical to a region spanning the boundary of exons 6 and 7 of SEQ ID NO: 8 (HSD17B13 Transcript E) when optimally aligned with SEQ ID NO: 8 to distinguish from Transcript G. It is understood that such a nucleic acid would be designed to hybridize to a sufficient number of nucleotides in each of exons 6 and 7 to distinguish from other features in the HSD17B13 Transcripts (particularly the additional guanine at the 3' end of exon 6 in Transcript H)).

Also provided are isolated nucleic acids comprising a region (e.g., at least 15 contiguous nucleotides) that hybridizes to a segment of a nucleic acid encoding an HSD17B13 protein that is present in Transcript F (or a fragment or homolog thereof) but not in Transcript A (or a fragment or homolog thereof). Such regions can be readily identified by comparing the sequences of the Transcripts. Transcript F (SEQ ID NO: 9) includes a read-through from exon 6 to intron 6 compared to Transcript A. Accordingly, provided herein are isolated nucleic acids that hybridize to at least 15 contiguous nucleotides of a nucleic acid encoding an HSD17B13 protein, wherein the contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region within the read-through into intron 6 in SEQ ID NO: 9 (HSD17B13 Transcript F) or a region spanning the boundary between the read-through into intron 6 and the rest of exon 6 in SEQ CD NO: 9 when optimally aligned with SEQ ID NO: 9. It is understood that such a nucleic acid would be designed to hybridize to a sufficient number of nucleotides in the read-through to distinguish the read-through from other features in the HSD17B13 Transcripts (e.g., from boundary of exons 6 and 7 in other HSD17B13 Transcripts). Optionally, the contiguous nucleotides comprise a sequence present in Transcript F (i.e., the inserted thymine) that is not present in Transcript F' (SEQ ID NO: 246). Transcript F' also includes a read-through from exon 6 into intron 6 compared to Transcript A, but the read-through does not include the inserted thymine present in the HSD17B13 rs72613567 variant gene.

As one example, the segment can comprise a region of SEQ ID NO: 9 within the read-through into intron 6 or spanning the boundary between the read-through into intron 6 and the rest of exon 6.

Also provided are isolated nucleic acids comprising a region (e.g., at least 15 contiguous nucleotides) that hybridizes to a segment of a nucleic acid encoding an HSD17B13 protein that is present in Transcript F' (or a fragment or homolog thereof) but not in Transcript A (or a fragment or homolog thereof). Such regions can be readily identified by comparing the sequences of the Transcripts. Transcript F' (SEQ ID NO: 246) includes a read-through from exon 6 to intron 6 compared to Transcript A. Accordingly, provided herein are isolated nucleic acids that hybridize to at least 15 contiguous nucleotides of a nucleic acid encoding an HSD17B13 protein, wherein the contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region within the read-through into intron 6 in SEQ ID NO: 246 (HSD17B13 Transcript F') or a region spanning the boundary between the read-through into intron 6 and the rest of exon 6 in SEQ ID NO: 246 when optimally aligned with SEQ ID NO: 246. It is understood that such a nucleic acid would be designed to hybridize to a sufficient number of nucleotides in the read-through to distinguish the read-through from other features in the HSD 7B13 Transcripts (e.g., from boundary of exons 6 and 7 in other HSD17B13 Transcripts). Optionally, the contiguous nucleotides comprise a sequence present in Transcript F' that is not present in Transcript F (SEQ ID NO: 9). The read-through in Transcript F includes the inserted thymine present in the HSD17B13 rs72613567 variant gene, whereas the read-through in Transcript F' does not.

As one example, the segment can comprise a region of SEQ ID NO: 246 within the read-through into intron 6 or spanning the boundary between the read-through into intron 6 and the rest of exon 6.

Also provided are isolated nucleic acids comprising a region (e.g., at least 15 contiguous nucleotides) that hybridizes to a segment of a nucleic acid encoding an HSD17B13 protein that is present in Transcript C (or a fragment or homolog thereof) but not in Transcript A (or a fragment or homolog thereof). Such regions can be readily identified by comparing the sequences of the Transcripts. Transcript C (SEQ ID NO: 6) is missing exon 6 compared to Transcript A (i.e., Transcript C includes an exon 5-exon 7 boundary not present in Transcript A). Accordingly, provided herein are isolated nucleic acids that hybridize to at least 15 contiguous nucleotides of a nucleic acid encoding an HSD17B13 protein, wherein the contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 5-exon 7 boundary in SEQ ID NO: 6 (HSD17B13 Transcript C) when optimally aligned with SEQ ID NO: 6. It is understood that such a nucleic acid would be designed to hybridize to a sufficient number of nucleotides in exons 5 and 7 to distinguish from other features in the HSD17B13 Transcripts (e.g., from boundary of exons 5 and 6 or of exons 6 and 7 in other HSD17B13 Transcripts).

As one example, the segment can comprise a region from SEQ ID NO: 6 spanning the exon 5-exon 7 boundary.

Also provided herein are isolated nucleic acids (e.g., antisense RNAs, siRNAs, or shRNAs) that hybridize to at least 15 contiguous nucleotides of a nucleic acid encoding an HSD17B13 protein, wherein contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region of HSD17B13 Transcript D (SEQ ID NO: 7). The isolated nucleic acids can comprise a region (e.g., at least 15 contiguous nucleotides) that hybridizes to a segment present in Transcript D (or fragments or homologs thereof) that is not present in Transcript A (or a fragment or homolog thereof). Such regions can be readily identified by comparing the sequences of the Transcripts. HSD17B13 Transcript D (SEQ ID NO: 7) includes an insertion of a guanine at the 3' end of exon 6, resulting in a frameshift in and premature truncation of exon 7 compared to Transcript A (SEQ ID NO: 4). For example, provided herein are isolated nucleic acids that hybridize to at least 15 contiguous nucleotides of a nucleic acid encoding an HSD17B13 protein, wherein contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 6-exon 7 boundary in SEQ ID NO: 7 (HSD17B13 Transcript D) when optimally aligned with SEQ ID NO: 7. The segment can include a guanine at a residue corresponding to residue 878 at the 3' end of exon 6 in SEQ ID NO: 7 (i.e., an insertion of a guanine at the 3' end of exon 6 relative to Transcript A in addition to the guanine at the start of exon 7). It is understood that such nucleic acids would be designed to hybridize to a sufficient number of nucleotides in each of exons 6 and 7 to distinguish the inserted guanine from other features in the HSD17B13 Transcripts (e.g., from the read-through into intron 6 in Transcript F or from the deleted exon 6 in Transcript C).

Also provided herein are isolated nucleic acids (e.g., antisense RNAs, siRNAs, or shRNAs) that hybridize to at least 15 contiguous nucleotides of a nucleic acid encoding an HSD17B13 protein, wherein contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region of HSD17B13 Transcript A (SEQ ID NO: 4). The isolated nucleic acids can comprise a region (e.g., at least 15 contiguous nucleotides) that hybridizes to a segment present in Transcript A (or fragments or homologs thereof) that is not present in Transcript D (or a fragment or homolog thereof). Such regions can be readily identified by comparing the sequences of the Transcripts. HSD17B13 Transcript D (SEQ ID NO: 7) includes an insertion of a guanine at the 3' end of exon 6, resulting in a frameshift in and premature truncation of exon 7 compared to Transcript A (SEQ ID NO: 4). For example, provided herein are isolated nucleic acids that hybridize to at least 15 contiguous nucleotides of a nucleic acid encoding an HSD17B13 protein, wherein contiguous nucleotides comprise a segment (e.g., at least 5 contiguous nucleotides, at least 10 contiguous nucleotides or at least 15 contiguous nucleotides) that is at least 90%, at least 95%, at least 96%, at least 97%, at least 98%, at least 99%, or 100% identical to a region spanning the exon 6-exon 7 boundary in SEQ ID NO: 4 (HSD17B13 Transcript A) when optimally aligned with SEQ ID NO: 4.

(5) Vectors

Also provided are vectors comprising any of the nucleic acids disclosed herein and a heterologous nucleic acid. The vectors can be viral or nonviral vectors capable of transporting a nucleic acid. In some cases, a vector can be a plasmid (e.g., a circular double-stranded DNA into which additional DNA segments can be ligated). In some cases, a vector can be a viral vector, wherein additional DNA segments can be ligated into the viral genome. In some cases, a vector can autonomously replicate in a host cell into which it is introduced (e.g., bacterial vectors having a bacterial origin of replication and episomal mammalian vectors). In other cases, vectors (e.g., non-episomal mammalian vectors) can be integrated into the genome of a host cell upon introduction into the host cell and thereby are replicated along with the host genome. Moreover, certain vectors can direct the expression of genes to which they are operatively linked. Such vectors can be referred to as “recombinant expression vectors” or “expression vectors.” Such vectors can also be targeting vectors (i.e., exogenous donor sequences) as disclosed elsewhere herein.

In some cases, the proteins encoded by the disclosed genetic variants are expressed by inserting nucleic acids encoding the disclosed genetic variants into expression vectors such that the genes are operatively linked to necessary expression control sequences such as transcriptional and translational control sequences. Expression vectors can include, for example, plasmids, retroviruses, adenoviruses, adeno-associated viruses (AAV), plant viruses such as cauliflower mosaic virus, tobacco mosaic virus, cosmids, YACs, EBV derived episomes, and the like. In some instances, nucleic acids comprising the disclosed genetic variants can be ligated into a vector such that transcriptional and translational control sequences within the vector serve their intended function of regulating the transcription and translation of the genetic variant. The expression vector and expression control sequences are chosen to be compatible with the expression host cell used. Nucleic acid sequences comprising the disclosed genetic variants can be inserted into separate vectors or into the same expression vector. A nucleic acid sequence comprising the disclosed genetic variants can be inserted into the expression vector by standard methods (e.g., ligation of complementary restriction sites on the nucleic acid comprising the disclosed genetic variants and vector, or blunt end ligation if no restriction sites are present).

In addition to a nucleic acid sequence comprising the disclosed genetic variants, the recombinant expression vectors can carry regulatory sequences that control the expression of the genetic variant in a host cell. The design of the expression vector, including the selection of regulatory sequences can depend on such factors as the choice of the host cell to be transformed, the level of expression of protein desired, and so forth. Preferred regulatory sequences for mammalian host cell expression can include, for example, viral elements that direct high levels of protein expression in mammalian cells, such as promoters and/or enhancers derived from retroviral LTRs, cytomegalovirus (CMV) (such as the CMV promoter/enhancer), Simian Virus 40 (SV40) (such as the SV40 promoter/enhancer), adenovirus, (e.g., the adenovirus major late promoter (AdMLP)), polyoma and strong mammalian promoters such as native immunoglobulin and actin promoters. Further description of viral regulatory elements, and sequences thereof is provided in U.S. Pat. Nos. 5,168,062; 4,510,245; and 4,968,615, each of which is herein incorporated by reference in its entirety for all purposes. Methods of expressing polypeptides in bacterial cells or fungal cells (e.g., yeast cells) are also well known.

In addition to a nucleic acid sequence comprising the disclosed genetic variants and regulatory sequences, the recombinant expression vectors can carry additional sequences, such as sequences that regulate replication of the vector in host cells (e.g., origins of replication) and selectable marker genes. A selectable marker gene can facilitate selection of host cells into which the vector has been introduced (see e.g., U.S. Pat. Nos. 4,399,216; 4,634,665; and 5,179,017, each of which is herein incorporated by reference in its entirety for all purposes). For example, a selectable marker gene can confer resistance to drugs, such as G418, hygromycin, or methotrexate, on a host cell into which the vector has been introduced. Exemplary selectable marker genes include the dihydrofolate reductase (DHFR) gene (for use in dhfr-host cells with methotrexate selection/amplification), the neo gene (for G418 selection), and the glutamate synthetase (GS) gene.

B. Proteins

Disclosed herein are isolated HSD17B13 proteins and fragments thereof, and particularly HSD17B13 proteins and fragments thereof produced by the HSD17B13 rs72613567 variant.

The isolated proteins disclosed herein can comprise an amino acid sequence of a naturally occurring HSD17B13 protein, or can comprise a non-naturally occurring sequence. In one example, the non-naturally occurring sequence can differ from the non-naturally occurring sequence due to conservative amino acid substitutions. For example, the sequence can be identical with the exception of conservative amino acid substitutions.

The isolated proteins disclosed herein can be linked or fused to heterologous polypeptides or heterologous molecules or labels, numerous examples of which are disclosed elsewhere herein. For example, the proteins can be fused to a heterologous polypeptide providing increased or decreased stability. The fused domain or heterologous polypeptide can be located at the N-terminus, the C-terminus, or internally within the protein. A fusion partner may, for example, assist in providing T helper epitopes (an immunological fusion partner), or may assist in expressing the protein (an expression enhancer) at higher yields than the native recombinant protein. Certain fusion partners are both immunological and expression enhancing fusion partners. Other fusion partners may be selected so as to increase the solubility of the polypeptide or to enable the polypeptide to be targeted to desired intracellular compartments. Still further fusion partners include affinity tags, which facilitate purification of the polypeptide.

A fusion protein may be directly fused to the heterologous molecule or may be linked to the heterologous molecule via a linker, such as a peptide linker. Suitable peptide linker sequences may be chosen, for example, based on the following factors: (1) their ability to adopt a flexible extended conformation; (2) their inability to adopt a secondary structure that could interact with functional epitopes on the first and second polypeptides; and (3) the lack of hydrophobic or charged residues that might react with the polypeptide functional epitopes. For example, peptide linker sequences may contain Gly, Asn and Ser residues. Other near neutral amino acids, such as Thr and Ala may also be used in the linker sequence. Amino acid sequences which may be usefully employed as linkers include those disclosed in Maratea et al. (1985) Gene 40:39-46; Murphy et al. (1986) Proc. Natl. Acad. Sci. USA 83:8258-8262; U.S. Pat. Nos. 4,935,233; and 4,751,180, each of which is herein incorporated by reference in its entirety. A linker sequence may generally be, for example, from 1 to about 50 amino acids in length. Linker sequences are generally not required when the first and second polypeptides have non-essential N-terminal amino acid regions that can be used to separate the functional domains and prevent steric interference.

The proteins can also be operably linked to a cell-penetrating domain. For example, the cell-penetrating domain can be derived from the HIV-1 TAT protein, the TLM cell-penetrating motif from human hepatitis B virus, MPG, Pep-1, VP22, a cell-penetrating peptide from Herpes simplex virus, or a polyarginine peptide sequence. See, e.g., WO 2014/089290, herein incorporated by reference in its entirety for all purposes. The cell-penetrating domain can be located at the N-terminus, the C-terminus, or anywhere within the protein.

The proteins can also be operably linked to a heterologous polypeptide for ease of tracking or purification, such as a fluorescent protein, a purification tag, or an epitope tag. Examples of fluorescent proteins include green fluorescent proteins (e.g., GFP, GFP-2, tagGFP, twfioGFP, eGFP, Emerald, Azami Green, Monomeric Azami Green, CopGFP, AceGFP, ZsGreen1), yellow fluorescent proteins (e.g., YFP, eYFP, Citrine, Venus, YPet, PhiYFP, ZsYellow1), blue fluorescent proteins (e.g., eBFP, eBFP2, Azurite, mKalamal, GFPuv, Sapphire, T-sapphire), cyan fluorescent proteins (e.g., eCFP, Cerulean, CyPet, AmCyanl, Midoriishi-Cyan), red fluorescent proteins (e.g., mKate, mKate2, mPlum, DsRed monomer, mCheny, mRFP1, DsRed-Express, DsRed2, DsRed-Monomer, HcRed-Tandem, HcRedl, AsRed2, egFP611, mRaspberry, mStrawberry, Jred), orange fluorescent proteins (e.g., mOrange, mKO, Kusabira-Orange, Monomeric Kusabira-Orange, mTangerine, tdTomato), and any other suitable fluorescent protein. Examples of tags include glutathione-S-transferase (GST), chitin binding protein (CBP), maltose binding protein, thioredoxin (TRX), poly(NANP), tandem affinity purification (TAP) tag, myc, AcV5, AU1, AUS, E, ECS, E2, FLAG, hemagglutinin (HA), nus, Softag 1, Softag 3, Strep, SBP, Glu-Glu, HSV, KT3, S. S1, 17, V5, VSV-G, histidine (His), biotin carboxyl carrier protein (BCCP), and calmodulin.

The isolated proteins herein can also comprise non-natural or modified amino acids or peptide analogs. For example, there are numerous D-amino acids or amino acids which have a different functional substituent than the naturally occurring amino acids. The opposite stereo isomers of naturally occurring peptides are disclosed, as well as the stereo isomers of peptide analogs. These amino acids can readily be incorporated into polypeptide chains by charging tRNA molecules with the amino acid of choice and engineering genetic constructs that utilize, for example, amber codons, to insert the analog amino acid into a peptide chain in a site-specific way (Thorson et al. (1991) *Methods Molec. Biol.* 77:43-73; Zoller (1992) *Current Opinion in Biotechnology* 3:348-354; Ibba, (1995) *Biotechnology & Genetic Engineering Reviews* 13:197 216; Cahill et al. (1989) *TIBS* 14(10):400-403; Benner (1993) *TIB Tech* 12:158-163; and Ibba and Hennecke (1994) *Biotechnology* 12:678-682, each of which are herein incorporated by reference in its entirety for all purposes).

Molecules can be produced that resemble peptides, but that are not connected via a natural peptide linkage. For example, linkages for amino acids or amino acid analogs can include CH2NH—, —CH2S—, —CH2—, —CH=CH— (cis and trans), —COCH2—, —CH(OH)CH2—, and —CHH2SO— (see, e.g., Spatola, A. F. in Chemistry and Biochemistry of Amino Acids, Peptides, and Proteins, B. Weinstein, eds., Marcel Dekker, New York, p. 267 (1983); *Spatola, A. F., Vega Data* (March 1983), Vol. 1, Issue 3, Peptide Backbone Modifications (general review); Morley (1994) *Trends Pharm Sci* 15(12):463-468; Hudson et al. (1979) *Int J Pep: Prot Res* 14:177-185; Spatola et al. (1986) *Life Sci* 38:1243-1249; Hann (1982) *Chem. Soc Perkin Trans. I* 307-314; Almquist et al. (1980) *J. Med Chem.* 23:1392-1398; Jennings-White et al. (1982) *Tetrahedron Lett* 23:2533); Szelke et al. European Appln, EP 45665 CA (1982): 97:39405 (1982); Holladay et al. (1983) *Tetrahedron. Lett* 24:4401-4404; and Hruby (1982) *Life Sci* 31:189-199; each of which is incorporated herein by reference in its entirety for all purposes. Peptide analogs can have more than one atom between the bond atoms, such as b-alanine, gaminobutyric acid, and the like.

Amino acid analogs and peptide analogs often have enhanced or desirable properties, such as, more economical production, greater chemical stability, enhanced pharmacological properties (half-life, absorption, potency, efficacy, and so forth), altered specificity (e.g., a broad-spectrum of biological activities), reduced antigenicity, and others desirable properties.

D-amino acids can be used to generate more stable peptides because D amino acids are not recognized by peptidases and such. Systematic substitution of one or more amino acids of a consensus sequence with a D-amino acid of the same type (e.g., D-lysine in place of L-lysine) can be used to generate more stable peptides. Cysteine residues can be used to cyclize or attach two or more peptides together. This can be beneficial to constrain peptides into particular conformations (see, e.g., Rizo and Gierasch (1992) *Ann. Rev. Biochem.* 61:387, herein by reference in its entirety for all purposes).

Also disclosed herein are nucleic acids encoding any of the proteins disclosed herein. This includes all degenerate sequences related to a specific polypeptide sequence (i.e., all nucleic acids having a sequence that encodes one particular polypeptide sequence as well as all nucleic acids, including degenerate nucleic acids, encoding the disclosed variants and derivatives of the protein sequences). Thus, while each particular nucleic acid sequence may not be written out herein, each and every sequence is in fact disclosed and described herein through the disclosed polypeptide sequences.

Also disclosed herein are compositions comprising an isolated polypeptide or protein disclosed herein and a carrier increasing the stability of the isolated polypeptide. Non-limiting examples of such carriers include poly(lactic acid) (PLA) microspheres, poly(D,L-lactic-coglycolic-acid) (PLGA) microspheres, liposomes, micelles, inverse micelles, lipid cochleates, and lipid microtubules.

(1) HSD17B13 Proteins and Fragments

Disclosed herein are isolated HSD17B13 proteins and fragments thereof, particularly HSD17B13 proteins and fragments thereof produced by the HSD17B13 rs72613567 variant, or particularly HSD17B13 Isoforms C, D, E, F, F', G, and H. Such proteins can include, for example an isolated polypeptide comprising at least 5, 6, 8, 10, 12, 14, 15, 16, 18, 20, 22, 24, 25, 30, 35, 40, 45, 50, 60, 70, 80, 90, 100, 150, 200, 250, or 300 contiguous amino acids of HSD17B13 Isoform C, D, E, F, F', G, or H or a fragment thereof. It is understood that gene sequences within a population and proteins encoded by such genes can vary due to polymorphisms such as single-nucleotide polymorphisms. The sequences provided herein for each HSD17B13 isoform are only exemplary sequences. Other sequences are also possible. For example, the isolated polypeptide comprises an amino acid sequence (e.g., a sequence of contiguous amino acids) at least 90%, at least 95%, at least 96%, at least 97%, at least 98%, at least 99%, or 100% identical to HSD17B13 Isoform C, D, E, F, F', G, or H when optimally aligned with Isoform C, D, E, F, F', G, or H, respectively. Optionally, the isolated polypeptide comprises a sequence identical to HSD17B13 Isoform C, D, E, F, F', G, or H.

As one example, the isolated polypeptide can comprise a segment (e.g., at least 8 contiguous amino acids) that is present in Isoforms D, G, and H (or fragments or homologs thereof) that is not present in Isoform A (or a fragment or homolog thereof). Such regions can be readily identified by comparing the sequences of the Isoforms. The region encoded by exon 7 in Isoforms D, G, and H is frameshifted and truncated compared to the region encoded by exon 7 in Isoform A. Thus, such an isolated polypeptide can comprise at least 5, 6, 8, 10, 12, 14, 15, 16, 18, 20, 22, 24, 25, 30, 35, 40, 45, 50, 60, 70, 80, 90, 100, 150, or 200 contiguous amino acids of an HSD17B13 protein (e.g., at least 8 contiguous amino acids, at least 10 contiguous amino acids, or at least 15 contiguous amino acids of an HSD17B13 protein), wherein a segment of the contiguous amino acids (e.g., at least 3 contiguous amino acids, at least 5 contiguous amino acids, at least 8 contiguous amino acids, at least 10 contiguous amino acids, or at least 15 contiguous amino acids) is at least 90%, at least 95%, at least 96%, at least 97%, at least 98%, at least 99%, or 100% identical to a segment including at least a portion of the region encoded by exon 7 in SEQ ID NO: 15 (HSD17B13 Isoform D), SEQ ID NO: 18 (HSD17B13 Isoform G), or SEQ ID NO: 19 (HSD17B13 Isoform H) when the isolated polypeptide is optimally aligned with SEQ ID NO: 15, 18, or 19, respectively.

Such isolated polypeptides can further comprise a segment present in Isoform D (or a fragment or homolog thereof) that is not present in Isoform G (or a fragment or homolog thereof), and can further comprise a segment present in Isoform D (or a fragment or homolog thereof) that is not present in Isoform H (or a fragment or homolog thereof). Such regions can be readily identified by comparing the sequences of the Isoforms. For example, such isolated polypeptides can comprise a segment of the contiguous amino acids (e.g., at least 3 contiguous amino acids, at least 5 contiguous amino acids, at least 8 contiguous amino acids, at least 10 contiguous amino acids, or at least 15 contiguous amino acids) that is at least 90%, at least 95%, at least 96%, at least 97%, at least 98%, or at least 99% identical to a segment spanning the boundary of the regions encoded by exons 3 and 4 of SEQ ID NO: 15 (HSD17B13 Isoform D) when optimally aligned with SEQ ID NO: 15 to distinguish from Isoform H. Likewise, such isolated polypeptides can comprise a segment of the contiguous amino acids (e.g., at least 3 contiguous amino acids, at least 5 contiguous amino acids, at least 8 contiguous amino acids, at least 10 contiguous amino acids, or at least 15 contiguous amino acids) that is at least 90%, at least 95%, at least 96%, at least 97%, at least 98%, or at least 99% identical to a segment within the region encoded by exon 2 in SEQ ID NO: 15 (HSD17B13 Isoform D), a segment spanning the boundary of the regions encoded by exons 1 and 2 in SEQ ID NO: 15, or a segment spanning the boundary of the regions encoded by exons 2 and 3 in SEQ ID NO: 15 when optimally aligned with SEQ ID NO: 15 to distinguish from Isoform G.

Like Isoform D, the region encoded by exon 7 in Isoform H (SEQ ID NO: 19) is frameshifted and truncated compared to Isoform A. In addition, however, Isoform H includes a region encoded by an additional exon (exon 3') between exons 3 and 4 compared to Isoforms A and D. Accordingly, such an isolated polypeptide can be as described above comprising a segment that is present in Isoforms D, G, and H (or fragments or homologs thereof) that is not present in Isoform A (or a fragment or homolog thereof) but further comprising a segment (e.g., at least 8 contiguous amino acids) from Isoform H (or a fragment or homolog thereof) that is not present in Isoform D (or a fragment or homolog thereof). Such regions can be readily identified by comparing the sequences of the Isoforms. For example, such an isolated polypeptide can further comprise a segment of the contiguous amino acids (e.g., at least 3 contiguous amino acids, at least 5 contiguous amino acids, at least 8 contiguous amino acids, at least 10 contiguous amino acids, or at least 15 contiguous amino acids) that is at least 90%, at least 95%, at least 96%, at least 97%, at least 98%, at least 99%, or 100% identical to a segment including at least a portion of the region encoded by exon 3' in SEQ ID NO: 19 (HSD17B13 Isoform H) when the isolated polypeptide is optimally aligned with SEQ ID NO: 19.

Like Isoform D, the region encoded by exon 7 in Isoform G (SEQ ID NO: 18) is frameshifted and truncated compared to Isoform A. In addition, however, Isoform G is missing the region encoded by exon 2 compared to Isoforms A and D and thus includes an exon 1-exon 3 boundary not present in Isoforms A and D. Accordingly, such an isolated polypeptide can be as described above comprising a segment that is present in Isoforms D, G, and H (or fragments or homologs thereof) that is not present in Isoform A (or a fragment or homolog thereof) but further comprising a segment (e.g., at least 8 contiguous amino acids) from Isoform G (or a fragment or homolog thereof) that is not present in Isoform D (or a fragment or homolog thereof). Such regions can be readily identified by comparing the sequences of the Isoforms. For example, such an isolated polypeptide can further comprise a segment of the contiguous amino acids (e.g., at least 3 contiguous amino acids, at least 5 contiguous amino acids, at least 8 contiguous amino acids, at least 10 contiguous amino acids, or at least 15 contiguous amino acids) that is at least 90%, at least 95%, at least 96%, at least 97%, at least 98%, at least 99%, or 100% identical to a segment spanning the boundary of the regions encoded by exons 1 and 3 in SEQ ID NO: 18 (HSD17B13 Isoform G) when the isolated polypeptide is optimally aligned with SEQ ID NO: 18.

Also provided herein are isolated polypeptides comprising a segment (e.g., at least 8 contiguous amino acids) that is present in Isoform E (or a fragment or homolog thereof) that is not present in Isoform A (or a fragment or homolog thereof). Isoform E includes a region encoded by an additional exon (exon 3') between exons 3 and 4 that is not present in Isoform A. Such regions can be readily identified by comparing the sequences of the Isoforms. Accordingly, the isolated polypeptide can comprise at least 5, 6, 8, 10, 12, 14, 15, 16, 18, 20, 22, 24, 25, 30, 35, 40, 45, 50, 60, 70, 80, 90, 100, 150, or 200 contiguous amino acids of an HSD17B13 protein (e.g., at least 8 contiguous amino acids, at least 10 contiguous amino acids, or at least 15 contiguous amino acids of an HSD17B13 protein), wherein a segment of the contiguous amino acids (e.g., at least 3 contiguous amino acids, at least 5 contiguous amino acids, at least 8 contiguous amino acids, at least 10 contiguous amino acids, or at least 15 contiguous amino acids) is at least 90%, at least 95%, at least 96%, at least 97%, at least 98%, at least 99%, or 100% identical to a segment including at least a portion of the region encoded by exon 3' in SEQ ID NO: 16 (HSD17B13 Isoform E) or SEQ ID NO: 19 (HSD17B13 Isoform H) when the isolated polypeptide is optimally aligned with SEQ ID NO: 16 or 19, respectively. Optionally, such an isolated polypeptide can further comprise a segment (e.g., at least 8 contiguous amino acids) from Isoform E (or a fragment or homolog thereof) that is not present in Isoform H (or a fragment or homolog thereof). Such regions can be readily identified by comparing the sequences of the Isoforms. For example, such an isolated polypeptide can further comprise a segment of the contiguous amino acids (e.g., at least 3 contiguous amino acids, at least 5 contiguous amino acids, at least 8 contiguous amino acids, at least 10 contiguous amino acids, or at least 15 contiguous amino acids) that is at least 90%, at least 95%, at least 96%, at least 97%, at least 98%, at least 99%, or 100% identical a segment spanning the boundary of the regions encoded by exons 6 and 7 in SEQ ID NO: 16 (HSD17B13 Isoform E) when the isolated polypeptide is optimally aligned with SEQ ID NO: 16.

Also provided is an isolated polypeptide comprising a segment (e.g., at least 8 contiguous amino acids) present in Isoform F (or a fragment or homolog thereof) that is not present in Isoform A (or a fragment or homolog thereof). Isoform F includes a region encoded by read-through from exon 6 into intron 6 that is not present in Isoform A. Such regions can be readily identified by comparing the sequences of the Isoforms. Accordingly, the isolated polypeptide can comprise at least 5, 6, 8, 10, 12, 14, 15, 16, 18, 20, 22, 24, 25, 30, 35, 40, 45, 50, 60, 70, 80, 90, 100, 150, or 200 contiguous amino acids of an HSD17B13 protein (e.g., at least 8 contiguous amino acids, at least 10 contiguous amino acids, or at least 15 contiguous amino acids of an HSD17B13 protein), wherein a segment of the contiguous amino acids (e.g., at least 3 contiguous amino acids, at least 5 contiguous amino acids, at least 8 contiguous amino acids, at least 10 contiguous amino acids, or at least 15 contiguous amino acids) is at least 90%, at least 95%, at least 96%, at least 97%, at least 98%, at least 99%, or 100% identical to a segment including at least a portion of the region encoded by the read-through into intron 6 in SEQ ID NO: 17 (HSD1 7B13 Isoform F) when the isolated polypeptide is optimally aligned with SEQ ID NO: 17.

Also provided is an isolated polypeptide comprising a segment (e.g., at least 8 contiguous amino acids) present in Isoform C (or a fragment or homolog thereof) that is not present in Isoform A (or a fragment or homolog thereof). Isoform C is missing the region encoded by exon 6 compared to Isoform A and includes an exon 5-exon 7 boundary not present in Isoform A. Such regions can be readily identified by comparing the sequences of the Isoforms. Accordingly, the isolated polypeptide can comprise at least 5, 6, 8, 10, 12, 14, 15, 16, 18, 20, 22, 24, 25, 30, 35, 40, 45, 50, 60, 70, 80, 90, 100, 150, or 200 contiguous amino acids of an HSD17B13 protein (e.g., at least 8 contiguous amino acids, at least 10 contiguous amino acids, or at least 15 contiguous amino acids of an HSD17B13 protein), wherein a segment of the contiguous amino acids (e.g., at least 3 contiguous amino acids, at least 5 contiguous amino acids, at least 8 contiguous amino acids, at least 10 contiguous amino acids, or at least 15 contiguous amino acids) is at least 90%, at least 95%, at least 96%, at least 97%, at least 98%, at least 99%, or 100% identical to a segment spanning the boundary of the regions encoded by exons 5 and 7 in SEQ ID NO: 14 (HSD17B13 Isoform C) when the isolated polypeptide is optimally aligned with SEQ ID NO: 14.

Any of the isolated polypeptides disclosed herein can be linked to a heterologous molecule or heterologous label. Examples of such heterologous molecules or labels are disclosed elsewhere herein. For example, the heterologous molecule can be an immunoglobulin Fc domain, a peptide tag as disclosed elsewhere herein, poly(ethylene glycol), polysialic acid, or glycolic acid.

(2) Methods of Producing HSD17B13 Proteins or Fragments

Also disclosed are methods of producing any of the HSD17B13 proteins or fragments thereof disclosed herein. Such HSD17B13 proteins or fragments thereof can be produced by any suitable method. For example, HSD17B13 proteins or fragments thereof can be produced from host cells comprising nucleic acids (e.g., recombinant expression vectors) encoding such HSD17B13 proteins or fragments thereof. Such methods can comprise culturing a host cell comprising a nucleic acid (e.g., recombinant expression vector) encoding an HSD17B13 protein or fragment thereof, thereby producing the HSD17B13 protein or fragment thereof. The nucleic acid can be operably linked to a promoter active in the host cell, and the culturing can be under conditions whereby the nucleic acid is expressed. Such methods can further comprise recovering the expressed HSD17B13 protein or fragment thereof. The recovering can further comprise purifying the HSD17B13 protein or fragment thereof.

Examples of suitable systems for protein expression include bacterial cell expression systems (e.g., Ischerichia coil, *Lactococcus lactis*), yeast cell expression systems (e.g., Saccharomvices *cerevisiae*, Pichiapastoris), insect cell expression systems (e.g., baculovirus-mediated protein expression), and mammalian cell expression systems.

Examples of nucleic acids encoding HSD17B13 proteins or fragments thereof are disclosed in more detail elsewhere herein. Optionally, such nucleic acids are codon optimized for expression in the host cell. Optionally, such nucleic acids are operably linked to a promoter active in the host cell. The promoter can be a heterologous promoter (i.e., a promoter than is not a naturally occurring HSD17B13 promoter). Examples of promoters suitable for Escherichia *coli* include arabinose, lac, lac, and 17 promoters. Examples of promoters suitable for *Lactococcus lactis* include P170 and nisin promoters. Examples of promoters suitable for *Saccharomyces cerevisiae* include constitutive promoters such as alcohol dehydrogenase (ADHI) or enolase (ENO) promoters or inducible promoters such as PHO, CUP 1, GAL 1, and G10. Examples of promoters suitable for *Pichia* pastoris include the alcohol oxidase I (AOX 1) promoter, the glyceraldehyde 3 phosphate dehydrogenase (GAP) promoter, and the glutathione dependent formaldehyde dehydrogenase (FLDI) promoter. An example of a promoter suitable for a baculovirus-mediated system is the late viral strong polyhedrin promoter.

Optionally, the nucleic acid further encodes a tag in frame with the HSD17B13 protein or fragment thereof to facilitate protein purification. Examples of tags are disclosed elsewhere herein. Such tags can, for example, bind to a partner ligand (e.g., immobilized on a resin) such that the tagged protein can be isolated from all other proteins (e.g., host cell proteins). Affinity chromatography, high performance liquid chromatography (HPLC), and size exclusion chromatography (SEC) are examples of methods that can be used to improve the purity of the expressed protein.

Other methods can also be used to produce HSD17B13 proteins or fragments thereof. For example, two or more peptides or polypeptides can be linked together by protein chemistry techniques. For example, peptides or polypeptides can be chemically synthesized using either Fmoc (9-fluorenylmethyloxycarbonyl) or Boc (tert-butyloxycarbonoyl) chemistry. Such peptides or polypeptides can be synthesized by standard chemical reactions. For example, a peptide or polypeptide can be synthesized and not cleaved from its synthesis resin, whereas the other fragment of a peptide or protein can be synthesized and subsequently cleaved from the resin, thereby exposing a terminal group which is functionally blocked on the other fragment. By peptide condensation reactions, these two fragments can be covalently joined via a peptide bond at their carboxyl and amino termini, respectively. (Grant G A (1992) Synthetic Peptides: A User Guide. W. H. Freeman and Co., N.Y. (1992); and Bodansky M and Trost B., Ed. (1993) Principles of Peptide Synthesis. Springer-Verlag Inc., NY, each of which is herein incorporated by reference in its entirety for all purposes). Alternatively, the peptide or polypeptide can be independently synthesized in vivo as described herein. Once isolated, these independent peptides or polypeptides may be linked to form a peptide or fragment thereof via similar peptide condensation reactions.

For example, enzymatic ligation of cloned or synthetic peptide segments allow relatively short peptide fragments to be joined to produce larger peptide fragments, polypeptides, or whole protein domains (Abrahmsen L et al. (1991) *Biochemistry* 30:4151, herein incorporated by reference in its entirety for all purposes). Alternatively, native chemical ligation of synthetic peptides can be utilized to synthetically construct large peptides or polypeptides from shorter peptide fragments. This method can consist of a two-step chemical reaction (Dawson et al. (1994) *Science* 266:776-779, herein incorporated by reference in its entirety for all purposes). The first step can be the chemoselective reaction of an unprotected synthetic peptide—thioester with another unprotected peptide segment containing an amino-terminal Cys residue to give a thioester-linked intermediate as the initial covalent product. Without a change in the reaction conditions, this intermediate can undergo spontaneous, rapid intramolecular reaction to form a native peptide bond at the ligation site (Baggiolini et al. (1992) *FEBS Lett* 307:97-101; Clark-Lewis et al. (1994). *J Biol Chem* 269:16075; Clark-Lewis et al. (1991) *Biochemistry* 30:3128; and Rajarathnam et al. (1994) *Biochemistry* 33:6623-6630, each of which is herein incorporated by reference in its entirety for all purposes).

Alternatively, unprotected peptide segments can be chemically linked where the bond formed between the peptide segments as a result of the chemical ligation is an unnatural (non-peptide) bond (Schnolzer et al. (1992) *Science* 256:22 1, herein incorporated by reference in its entirety for all purposes). This technique has been used to synthesize analogs of protein domains as well as large amounts of relatively pure proteins with full biological activity (deLisle Milton R C et al., Techniques in Protein Chemistry IV. Academic Press, New York, pp. 257-267 (1992), herein incorporated by reference in its entirety for all purposes).

C. Cells

Also provided herein are cells (e.g., recombinant host cells) comprising any of the nucleic acids and proteins disclosed herein. The cells can be in vitro, ex vivo, or in vivo. Nucleic acids can be linked to a promoter and other regulatory sequences so they are expressed to produce an encoded protein. Any type of cell is provided.

The cell can be, for example, a totipotent cell or a pluripotent cell (e.g., an embryonic stem (ES) cell such as a rodent ES cell, a mouse ES cell, or a rat ES cell). Totipotent cells include undifferentiated cells that can give rise to any cell type, and pluripotent cells include undifferentiated cells that possess the ability to develop into more than one differentiated cell types. Such pluripotent and/or totipotent cells can be, for example, ES cells or ES-like cells, such as an induced pluripotent stem (iPS) cells. ES cells include embryo-derived totipotent or pluripotent cells that are capable of contributing to any tissue of the developing embryo upon introduction into an embryo. ES cells can be derived from the inner cell mass of a blastocyst and are capable of differentiating into cells of any of the three vertebrate germ layers (endoderm, ectoderm, and mesoderm).

The cell can also be a primary somatic cell, or a cell that is not a primary somatic cell. Somatic cells can include any cell that is not a gamete, germ cell, gametocyte, or undifferentiated stem cell. The cell can also be a primary cell. Primary cells include cells or cultures of cells that have been isolated directly from an organism, organ, or tissue. Primary cells include cells that are neither transformed nor immortal. They include any cell obtained from an organism, organ, or tissue which was not previously passed in tissue culture or has been previously passed in tissue culture but is incapable of being indefinitely passed in tissue culture. Such cells can be isolated by conventional techniques and include, for example, somatic cells, hematopoietic cells, endothelial cells, epithelial cells, fibroblasts, mesenchymal cells, keratinocytes, melanocytes, monocytes, mononuclear cells, adipocytes, preadipocytes, neurons, glial cells, hepatocytes, skeletal myoblasts, and smooth muscle cells. For example, primary cells can be derived from connective tissues, muscle tissues, nervous system tissues, or epithelial tissues.

Such cells also include would normally not proliferate indefinitely but, due to mutation or alteration, have evaded normal cellular senescence and instead can keep undergoing division. Such mutations or alterations can occur naturally or be intentionally induced. Examples of immortalized cells include Chinese hamster ovary (CHO) cells, human embryonic kidney cells (e.g., HEK 293 cells), and mouse embryonic fibroblast cells (e.g., 3T3 cells). Numerous types of immortalized cells are well known. Immortalized or primary cells include cells that are typically used for culturing or for expressing recombinant genes or proteins.

The cell can also be a differentiated cell, such as a liver cell (e.g., a human liver cell).

The cell can be from any source. For example, the cell can be a eukaryotic cell, an animal cell, a plant cell, or a fungal (e.g., yeast) cell. Such cells can be fish cells or bird cells, or such cells can be mammalian cells, such as human cells, non-human mammalian cells, rodent cells, mouse cells or rat cells. Mammals include, for example, humans, non-human primates, monkeys, apes, cats dogs, horses, bulls, deer, bison, sheep, rodents (e.g., mice, rats, hamsters, guinea pigs), livestock (e.g., bovine species such as cows, steer, etc.; ovine species such as sheep, goats, etc.; and porcine species such as pigs and boars). Birds include, for example, chickens, turkeys, ostrich, geese, ducks, etc. Domesticated animals and agricultural animals are also included. The term "non-human animal" excludes humans.

For mouse cells, the mouse can be any strain, including, for example, from a 129 strain, a C57BL/6 strain, a BALB/c strain, a Swiss Webster strain, a mix of 129 and C57BL/6, strains, a mix of BALB/c and C57BL/6 strains, a mix of 129 and BALB/c strains, and a mix of BALB/c, C57BL/6, and 129 strains. For example, a mouse can be at least partially from a BALB/c strain (e.g., at least about 25%, at least about 50%, at least about 75% derived from a BALB/c strain, or about 25%, about 50%, about 75%, or about 100% derived from a BALB/c strain). In one example, the mouse is a strain comprising 50% BALB/c, 25% C57BL/6, and 25% 129. Alternatively, the mouse comprises a strain or strain combination that excludes BALB/c.

Examples of 129 strains include 129P1, 129P2, 129P3, 129X1, 129S1 (e.g., 129S1/SV, 129S1/Svlm), 129S2, 129S4, 129S5, 129S9/SvEvH, 129S6 (129/SvEvTac), 129S7, 129S8, 129T 1, and 129T2. See, e.g., Festing et al. (1999) *Mammalian Genome* 10(8):836, herein incorporated by reference in its entirety for all purposes. Examples of C57BL strains include C57BL/A, C57BL/An, C57BL/GrFa, C57BL/Kal wN, C57BL/6, C57BL/6J, C57BL/6ByJ, C57BL/6NJ, C57BL/10, C57BL/10ScSn, C57BL/10Cr, and C57BL/Ola. Mouse cells also be from a mix of an aforementioned 129 strain and an aforementioned C57BL/6 strain (e.g., 50% 129 and 50% C57BL/6). Likewise, mouse cells can be from a mix of aforementioned 129 strains or a mix of aforementioned BL/6 strains (e.g., the 129S6 (129/SvEvTac) strain).

For rat cells, the rat can be any rat strain, including, for example, an ACI rat strain, a Dark Agouti (DA) rat strain, a Wistar rat strain, a LEA rat strain, a Sprague Dawley (SD) rat strain, or a Fischer rat strain such as Fisher F344 or Fisher F6. Rats can also be from a strain derived from a mix of two or more strains recited above. For example, the rat can be from a DA strain or an ACI strain. The ACI rat strain is characterized as having black agouti, with white belly and feet and an $RT1^{av1}$ haplotype. Such strains are available from a variety of sources including Harlan Laboratories. The Dark Agouti (DA) rat strain is characterized as having an agouti coat and an $RT1^{av1}$ haplotype. Such rats are available from a variety of sources including Charles River and Harlan Laboratories. In some cases, the rats are from an inbred rat strain. See, e.g., US 2014/0235933 A1, herein incorporated by reference in its entirety for all purposes.

III. Methods of Modifying or Altering Expression of HSD17B13

Various methods are provided for modifying a cell through use of any combination of nuclease agents, exogenous donor sequences, transcriptional activators, transcriptional repressors, anti sense molecules such as anti sense RNA, siRNA, and shRNA, HSD17B13 proteins or fragments thereof, and expression vectors for expressing a recombinant HSD17B13 gene or a nucleic acid encoding an HSD17B13 protein. The methods can occur in viaro, ex vivo, or in vivo. The nuclease agents, exogenous donor sequences, transcriptional activators, transcriptional repressors, antisense molecules such as antisense RNA, siRNA, and shRNA, HSD17B13 proteins or fragments thereof, and expression vectors can be introduced into the cell in any form and by any means as described elsewhere herein, and all or some can be introduced simultaneously or sequentially in any combination. Some methods involve only altering an endogenous HSD17B13 gene in a cell. Some methods involve only altering expression of an endogenous HSD17B13 gene through use of transcriptional activators or repressors or through use of antisense molecules such as antisense RNA, siRNA, and shRNA. Some methods involve only introducing a recombinant HSD17B13 gene or nucleic acid encoding an HSD17B13 protein or fragment thereof into a cell. Some methods involve only introducing an HSD17B13 protein or fragment thereof into a cell (e.g., any one of or any combination of the HSD17B13 proteins or fragments thereof disclosed herein or any one of or any combination of HSD17B13 Isoforms A-H or fragments thereof disclosed herein). For example, such methods can involve introducing one or more of HSD17B13 Isoforms C, D, F, G, and H (or fragments thereof) into a cell or introducing HSD17B13 Isoform D (or a fragment thereof)

into a cell. Alternatively, such methods can involve introducing one or more of HSD17B13 Isoforms A, B, and E or Isoforms A, B, E, and F' (or fragments thereof) into a cell or introducing HSD17B13 Isoform A (or a fragment thereof) into a cell. Other methods can involve both altering an endogenous HSD17B13 gene in a cell and introducing an HSD17B13 protein or fragment thereof or recombinant HSD17B13 gene or nucleic acid encoding an HSD17B13 protein or fragment thereof into the cell. Yet other methods can involve both altering expression of an endogenous HSD17B13 gene in a cell and introducing an HSD17B13 protein or fragment thereof or recombinant HSD17B13 gene or nucleic acid encoding an HSD17B13 protein or fragment thereof into the cell.

A. Methods of Modifying HSD17B13 Nucleic Acids

Various methods are provided for modifying an HSD17B13 gene in a genome within a cell (e.g., a pluripotent cell or a differentiated cell such as a liver cell) through use of nuclease agents and/or exogenous donor sequences. The methods can occur in vitro, ex vivo, or in vivo. The nuclease agent can be used alone or in combination with an exogenous donor sequence. Alternatively, the exogenous donor sequence can be used alone or in combination with a nuclease agent.

Repair in response to double-strand breaks (DSBs) occurs principally through two conserved DNA repair pathways: non-homologous end joining (NHEJ) and homologous recombination (HR). See Kasparek & Humphrey (2011) *Seminars in Cell & Dev. Biol.* 22:886 897, herein incorporated by reference in its entirety for all purposes. NHEJ includes the repair of double-strand breaks in a nucleic acid by direct ligation of the break ends to one another or to an exogenous sequence without the need for a homologous template. Ligation of non-contiguous sequences by NHEJ can often result in deletions, insertions, or translocations near the site of the double-strand break.

Repair of a target nucleic acid (e.g., an HSD17B13 gene) mediated by an exogenous donor sequence can include any process of exchange of genetic information between the two polynucleotides. For example, NHEJ can also result in the targeted integration of an exogenous donor sequence through direct ligation of the break ends with the ends of the exogenous donor sequence (i.e., NHEJ-based capture). Such NHEJ-mediated targeted integration can be preferred for insertion of an exogenous donor sequence when homology directed repair (HDR) pathways are not readily usable (e.g., in non-dividing cells, primary cells, and cells which perform homology-based DNA repair poorly). In addition, in contrast to homology-directed repair, knowledge concerning large regions of sequence identity flanking the cleavage site (beyond the overhangs created by Cas-mediated cleavage) is not needed, which can be beneficial when attempting targeted insertion into organisms that have genomes for which there is limited knowledge of the genomic sequence. The integration can proceed via ligation of blunt ends between the exogenous donor sequence and the cleaved genomic sequence, or via ligation of sticky ends (i.e., having 5' or 3' overhangs) using an exogenous donor sequence that is flanked by overhangs that are compatible with those generated by the Cas protein in the cleaved genomic sequence. See, e.g., US 2011/020722, WO 2014/033644, WO 2014/089290, and Maresca etal. (2013) *Genome Res.* 23(3):539-546, each of which is herein incorporated by reference in its entirety for all purposes. If blunt ends are ligated, target and/or donor resection may be needed to generation regions of microhomology needed for fragment joining, which may create unwanted alterations in the target sequence.

Repair can also occur via homology directed repair (HDR) or homologous recombination (HR). HDR or HR includes a form of nucleic acid repair that can require nucleotide sequence homology, uses a "donor" molecule as a template for repair of a "target" molecule (i.e., the one that experienced the double-strand break), and leads to transfer of genetic information from the donor to target. Without wishing to be bound by any particular theory, such transfer can involve mismatch correction of heteroduplex DNA that forms between the broken target and the donor, and/or synthesis-dependent strand annealing, in which the donor is used to resynthesize genetic information that will become part of the target, and/or related processes. In some cases, the donor polynucleotide, a portion of the donor polynucleotide, a copy of the donor polynucleotide, or a portion of a copy of the donor polynucleotide integrates into the target DNA. See Wang et al. (2013) Cell 153:910-918; Mandalos et al. (2012) *PLOS ONE* 7:e45768:1-9; and Wang et al. (2013) *Nat Biotechnol.* 31:530-532, each of which is herein incorporated by reference in its entirety for all purposes.

Targeted genetic modifications to an HSD17B13 gene in a genome can be generated by contacting a cell with an exogenous donor sequence comprising a 5' homology arm that hybridizes to a 5' target sequence at a target genomic locus within the HSD17B13 gene and a 3' homology arm that hybridizes to a 3' target sequence at the target genomic locus within the HSD17B13 gene. The exogenous donor sequence can recombine with the target genomic locus to generate the targeted genetic modification to the HSD17B13 gene. As one example, the 5' homology arm can hybridize to a target sequence 5' of the position corresponding to position 12666 of SEQ ID NO: 2, and the 3' homology arm can hybridize to a target sequence 3' of the position corresponding to position 12666 of SEQ ID NO: 2 when the HSD17B13 gene is optimally aligned with SEQ ID NO: 2. Such methods can result, for example, in an HSD17B13 gene in which a thymine is inserted between nucleotides corresponding to positions 12665 and 12666 of SEQ ID NO: 1 when the HSD17B13 gene is optimally aligned with SEQ ID NO: 1 (or an adenine is inserted at the corresponding position on the opposite strand). As another example, the 5' and 3' homology arms can hybridize to 5' and 3' target sequences, respectively, at positions corresponding to those flanking exon 6 in SEQ ID NO: 1 when the HSD17B13 gene is optimally aligned with SEQ ID NO: 1. Such methods can result, for example, in an HSD17B13 gene in which a sequence corresponding to exon 6 of SEQ ID NO: 1 when the HSD17B13 gene is optimally aligned with SEQ ID NO: 1 has been deleted. As another example, the 5' and 3' homology arms can hybridize to 5' and 3' target sequences, respectively, at positions corresponding to those flanking exon 2 in SEQ ID NO: 1 when the HSD17B13 gene is optimally aligned with SEQ ID NO: 1. Such methods can result, for example, in an HSD17B13 gene in which a sequence corresponding to exon 2 of SEQ ID NO: 1 when the HSD17B13 gene is optimally aligned with SEQ ID NO: 1 has been deleted. As another example, the 5' and 3' homology arms can hybridize to 5' and 3' target sequences, respectively, at positions corresponding to the exon 6/intron 6 boundary in SEQ ID NO: 1 when the HSD17B13 gene is optimally aligned with SEQ ID NO: 1. As another example, the 5' and 3' homology arms can hybridize to 5' and 3' target sequences, respectively, at positions corresponding to exon 6 and exon 7 in SEQ ID NO: 1 when the HSD17B13 gene is optimally aligned with SEQ ID NO: 1. Such methods can result, for example, in an HSD17B13 gene in which a thymine is inserted between nucleotides corresponding to positions 12665 and 12666 of SEQ ID NO: 1 when the HSD17B13 gene is optimally aligned with SEQ ID NO: 1 (or an adenine is inserted at the corresponding position on the opposite strand). As another example, the 5' and 3' homology arms can hybridize to 5' and 3' target sequences, respectively, at positions corresponding to those flanking or within the region corresponding to the donor splice site in intron 6 of SEQ ID NO: 1 (i.e., the region at the 5' end of intron 6 in SEQ ID NO: 1). Such methods can result, for example, in an HSD17B13 gene in which the donor splice site in intron 6 is disrupted. Examples of exogenous donor sequences are disclosed elsewhere herein.

Targeted genetic modifications to an HSD17B13 gene in a genome can also be generated by contacting a cell with a nuclease agent that induces one or more nicks or double-strand breaks at a target sequence at a target genomic locus within the HSD17B13 gene. Such methods can result, for example, in an HSD17B13 gene in which the region corresponding to the donor splice site in intron 6 of SEQ ID NO: 1 is disrupted (i.e., the region at the 5' end of intron 6 in SEQ ID NO: 1). Examples and variations of nuclease agents that can be used in the methods are described elsewhere herein.

For example, targeted genetic modifications to an HSD17B13 gene in a genome can be generated by contacting a cell or the genome of a cell with a Cas protein and one or more guide RNAs that hybridize to one or more guide RNA recognition sequences within a target genomic locus in the HSD17B13 gene. That is, targeted genetic modifications to an HSD17B13 gene in a genome can be generated by contacting a cell or the genome of a cell with a Cas protein and one or more guide RNAs that target one or more guide RNA target sequences within a target genomic locus in the HSD17B13 gene. For example, such methods can comprise contacting a cell with a Cas protein and a guide RNA that target a guide RNA target sequence within the HSD17B13 gene. As one example, the guide RNA target sequence is within a region corresponding to exon 6 and/or intron 6 of SEQ ID NO: 2 when the HSD17B13 gene is optimally aligned with SEQ ID NO: 2. As one example, the guide RNA target sequence is within a region corresponding to exon 6 and/or intron 6 and/or exon 7 (e.g., exon 6 and/or intron 6, or exon 6 and/or exon 7), of SEQ ID NO: 2 when the HSD17B13 gene is optimally aligned with SEQ ID NO: 2. As another example, the guide RNA target sequence can includes or is proximate to a position corresponding to position 12666 of SEQ ID NO: 2 when the HSD17B13 gene is optimally aligned with SEQ ID NO: 2. For example, the guide RNA target sequence can be within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2. As yet another example, the guide RNA target sequence can include or be proximate to the start codon of an HSD17B13 gene or the stop codon of an HSD17B13 gene. For example, the guide RNA target sequence can be within about 10, 20, 30, 40, 50, 100, 200, 300, 400, 500, or 1,000 nucleotides of the start codon or the stop codon. The Cas protein and the guide RNA form a complex, and the Cas protein cleaves the guide RNA target sequence. Cleavage by the Cas protein can create a double-strand break or a single-strand break (e.g., if the Cas protein is a nickase). Such methods can result, for example, in an HSD17B13 gene in which the region corresponding to the donor splice site in intron 6 of SEQ ID NO: 1 is disrupted (i.e., the region at the 5' end of intron 6 in SEQ ID NO: 1), the start codon is disrupted, the stop codon is disrupted, or the coding sequence is deleted. Examples and variations of Cas (e.g., Cas9) proteins and guide RNAs that can be used in the methods are described elsewhere herein.

In some methods, two or more nuclease agents can be used. For example, two nuclease agents can be used, each targeting a nuclease target sequence within a region corresponding to exon 6 and/or intron 6, or exon 6 and/or exon 7, of SEQ ID NO: 2 when the HSD17B13 gene is optimally aligned with SEQ ID NO: 2, or including or proximate to a position corresponding to position 12666 of SEQ ID NO: 2 when the HSD17B13 gene is optimally aligned with SEQ ID NO: 2 (e.g., within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2). For example, two nuclease agents can be used, each targeting a nuclease target sequence within a region corresponding to exon 6 and/or intron 6 and/or exon 7, of SEQ ID NO: 2 when the HSD17B13 gene is optimally aligned with SEQ ID NO: 2. As another example, two or more nuclease agents can be used, each targeting a nuclease target sequence including or proximate to the start codon. As another example, two nuclease agents can be used, one targeting a nuclease target sequence including or proximate to the start codon, and one targeting a nuclease target sequence including or proximate to the stop codon, wherein cleavage by the nuclease agents can result in deletion of the coding region between the two nuclease target sequences. As yet another example, three or more nuclease agents can be used, with one or more (e.g., two) targeting nuclease target sequences including or proximate to the start codon, and one or more (e.g., two) targeting nuclease target sequences including or proximate to the stop codon, wherein cleavage by the nuclease agents can result in deletion of the coding region between the nuclease target sequences including or proximate to the start codon and the nuclease target sequence including or proximate to the stop codon.

Optionally, the cell can be further contacted with one or more additional guide RNAs that target additional guide RNA target sequences within the target genomic locus in the HSD17B13 gene. By contacting the cell with one or more additional guide RNAs (e.g., a second guide RNA that target a second guide RNA target sequence), cleavage by the Cas protein can create two or more double-strand breaks or two or more single-strand breaks (e.g., if the Cas protein is a nickase).

Optionally, the cell can additionally be contacted with one or more exogenous donor sequences which recombine with the target genomic locus in the HSD17B13 gene to generate a targeted genetic modification. Examples and variations of exogenous donor sequences that can be used in the methods are disclosed elsewhere herein.

The Cas protein, guide RNA(s), and exogenous donor sequence(s) can be introduced into the cell in any form and by any means as described elsewhere herein, and all or some of the Cas protein, guide RNA(s), and exogenous donor sequence(s) can be introduced simultaneously or sequentially in any combination.

In some such methods, the repair of the target nucleic acid (e.g., the HSD17B13 gene) by the exogenous donor sequence occurs via homology-directed repair (HDR). Homology-directed repair can occur when the Cas protein cleaves both strands of DNA in the HSD17B13 gene to create a double-strand break, when the Cas protein is a nickase that cleaves one strand of DNA in the target nucleic acid to create a single-strand break, or when Cas nickases are used to create a double-strand break formed by two offset nicks. In such methods, the exogenous donor sequence comprises 5' and 3' homology arms corresponding to 5' and 3' target sequences. The guide RNA target sequence(s) or cleavage site(s) can be adjacent to the 5' target sequence, adjacent to the 3' target sequence, adjacent to both the 5' target sequence and the 3' target sequence, or adjacent to neither the 5' target sequence nor the 3' target sequence. Optionally, the exogenous donor sequence can further comprise a nucleic acid insert flanked by the 5' and 3' homology arms, and the nucleic acid insert is inserted between the 5' and 3' target sequences. If no nucleic acid insert is present, the exogenous donor sequence can function to delete the genomic sequence between the 5' and 3' target sequences. Examples of exogenous donor sequences are disclosed elsewhere herein.

Alternatively, the repair of the HSD17B13 gene mediated by the exogenous donor sequence can occur via non-homologous end joining (NHEJ)-mediated ligation. In such methods, at least one end of the exogenous donor sequence comprises a short single-stranded region that is complementary to at least one overhang created by Cas-mediated cleavage in the HSD17B13 gene. The complementary end in the exogenous donor sequence can flank a nucleic acid insert. For example, each end of the exogenous donor sequence can comprise a short single-stranded region that is complementary to an overhang created by Cas-mediated cleavage in the HSD17B13 gene, and these complementary regions in the exogenous donor sequence can flank a nucleic acid insert.

Overhangs (i.e., staggered ends) can be created by resection of the blunt ends of a double-strand break created by Cas-mediated cleavage. Such resection can generate the regions of microhomology needed for fragment joining, but this can create unwanted or uncontrollable alterations in the HSD17B13 gene. Alternatively, such overhangs can be created by using paired Cas nickases. For example, the cell can be contacted with first and second nickases that cleave opposite strands of DNA, whereby the genome is modified through double nicking. This can be accomplished by contacting a cell with a first Cas protein nickase, a first guide RNA that target a first guide RNA target sequence within the target genomic locus in the HSD17B13 gene, a second Cas protein nickase, and a second guide RNA that targets a second guide RNA target sequence within target genomic locus in the HSD17B13 gene. The first Cas protein and the first guide RNA form a first complex, and the second Cas protein and the second guide RNA form a second complex. The first Cas protein nickase cleaves a first strand of genomic DNA within the first guide RNA target sequence, the second Cas protein nickase cleaves a second strand of genomic DNA within the second guide RNA target sequence, and optionally the exogenous donor sequence recombines with the target genomic locus in the HSD17B13 gene to generate the targeted genetic modification.

The first nickase can cleave a first strand of genomic DNA (i.e., the complementary strand), and the second nickase can cleave a second strand of genomic DNA (i.e., the non-complementary strand). The first and second nickases can be created, for example, by mutating a catalytic residue in the RuvC domain (e.g., the D 10A mutation described elsewhere herein) of Cas9 or mutating a catalytic residue in the HNH domain (e.g., the H840A mutation described elsewhere herein) of Cas9. In such methods, the double nicking can be employed to create a double-strand break having staggered ends (i.e., overhangs). The first and second guide RNA target sequences can be positioned to create a cleavage site such that the nicks created by the first and second nickases on the first and second strands of DNA create a double-strand break. Overhangs are created when the nicks within the first and second CRISPR RNA target sequences are offset. The offset window can be, for example, at least about 5 bp, 10 bp, 20 bp, 30 bp, 40 bp, 50 bp, 60 bp, 70 bp, 80 bp, 90 bp, 100 bp or more. See, e.g., Ran etal. (2013) *Cell* 154:1380-1389; Mali el al. (2013) *Nat. Biotech.* 31:833-838; and Shen et al. (2014) *Nat. Methods* 11:399-404, each of which is herein incorporated by reference in its entirety for all purposes.

(1) Types of Targeted Genetic Modifications

Various types of targeted genetic modifications can be introduced using the methods described herein. Such targeted modifications can include, for example, additions of one or more nucleotides, deletions of one or more nucleotides, substitutions of one or more nucleotides, a point mutation, or a combination thereof. For example, at least 1, 2, 3, 4, 5, 7, 8, 9, 10 or more nucleotides can be changed (e.g., deleted, inserted, or substituted) to form the targeted genomic modification. The deletions, insertions, or substitutions can be of any size, as disclosed elsewhere herein. See, e.g., Wang et al. (2013) *Cell* 153:910-918; Mandalos et al. (2012) *PLOS ONE* 7:e45768:1-9; and Wang et al. (2013) *Nat Biotechnol.* 31:530-532, each of which is herein incorporated by reference in its entirety for all purposes.

Such targeted genetic modifications can result in disruption of a target genomic locus. Disruption can include alteration of a regulatory element (e.g., promoter or enhancer), a missense mutation, a nonsense mutation, a frame-shift mutation, a truncation mutation, a null mutation, or an insertion or deletion of small number of nucleotides (e.g., causing a frameshift mutation), and it can result in inactivation (i.e., loss of function) or loss of an allele. For example, a targeted modification can comprise disruption of the start codon of an HSD17B13 gene such that the start codon is no longer functional.

In a specific example, a targeted modification can comprise a deletion between first and second guide RNA target sequences or Cas cleavage sites. If an exogenous donor sequence (e.g., repair template or targeting vector) is used, the modification can comprise a deletion between first and second guide RNA target sequences or Cas cleavage sites as well as an insertion of a nucleic acid insert between the 5' and 3' target sequences.

Alternatively, if an exogenous donor sequence is used, alone or in combination with a nuclease agent, the modification can comprise a deletion between the 5' and 3' target sequences as well as an insertion of a nucleic acid insert between the 5' and 3' target sequences in the pair of first and second homologous chromosomes, thereby resulting in a homozygous modified genome. Alternatively, if the exogenous donor sequence comprises 5' and 3' homology arms with no nucleic acid insert, the modification can comprise a deletion between the 5' and 3' target sequences.

The deletion between the first and second guide RNA target sequences or the deletion between the 5' and 3' target sequences can be a precise deletion wherein the deleted nucleic acid consists of only the nucleic acid sequence between the first and second nuclease cleavage sites or only the nucleic acid sequence between the 5' and 3' target sequences such that there are no additional deletions or insertions at the modified genomic target locus. The deletion between the first and second guide RNA target sequences can also be an imprecise deletion extending beyond the first and second nuclease cleavage sites, consistent with imprecise repair by non-homologous end joining (NHEJ), resulting in additional deletions and/or insertions at the modified genomic locus. For example, the deletion can extend about 1 bp, about 2 bp, about 3 bp, about 4 bp, about 5 bp, about 10 bp, about 20 bp, about 30 bp, about 40 bp, about 50 bp, about 100 bp, about 200 bp, about 300 bp, about 400 bp, about 500 bp, or more beyond the first and second Cas protein cleavage sites. Likewise, the modified genomic locus can comprise additional insertions consistent with imprecise repair by NHEJ, such as insertions of about 1 bp, about 2 bp, about 3 bp, about 4 bp, about 5 bp, about 10 bp, about 20 bp, about 30 bp, about 40 bp, about 50 bp, about 100 bp, about 200 bp, about 300 bp, about 400 bp, about 500 bp, or more.

The targeted genetic modification can be, for example, a biallelic modification or a monoallelic modification. Biallelic modifications include events in which the same modification is made to the same locus on corresponding homologous chromosomes (e.g., in a diploid cell), or in which different modifications are made to the same locus on corresponding homologous chromosomes. In some methods, the targeted genetic modification is a monoallelic modification. A monoallelic modification includes events in which a modification is made to only one allele (i.e., a modification to the HSD17B13 gene in only one of the two homologous chromosomes). Homologous chromosomes include chromosomes that have the same genes at the same loci but possibly different alleles (e.g., chromosomes that are paired during meiosis). The term allele includes any of one or more alternative forms of a genetic sequence. In a diploid cell or organism, the two alleles of a given sequence typically occupy corresponding loci on a pair of homologous chromosomes.

A monoallelic mutation can result in a cell that is heterozygous for the targeted HSD17B13 modification. Heterozygosity includes situation in which only one allele of the HSD17B13 gene (i.e., corresponding alleles on both homologous chromosomes) have the targeted modification.

A biallelic modification can result in homozygosity for a targeted modification. Homozygosity includes situations in which both alleles of the HSD17B13 gene (i.e., corresponding alleles on both homologous chromosomes) have the targeted modification. Alternatively, a biallelic modification can result in compound heterozygosity (e.g., hemizygosity) for the targeted modification. Compound heterozygosity includes situations in which both alleles of the target locus (i.e., the alleles on both homologous chromosomes) have been modified, but they have been modified in different ways (e.g., a targeted modification in one allele and inactivation or disruption of the other allele). For example, in the allele without the targeted modification, a double-strand break created by the Cas protein may have been repaired by non-homologous end joining (NHEJ)-mediated DNA repair, which generates a mutant allele comprising an insertion or a deletion of a nucleic acid sequence and thereby causes disruption of that genomic locus. For example, a biallelic modification can result in compound heterozygosity if the cell has one allele with the targeted modification and another allele that is not capable of being expressed. Compound heterozygosity includes hemizygosity. Hemizygosity includes situations in which only one allele (i.e., an allele on one of two homologous chromosomes) of the target locus is present. For example, a biallelic modification can result in hemizygosity for a targeted modification if the targeted modification occurs in one allele with a corresponding loss or deletion of the other allele.

(2) Identifying Cells with Targeted Genetic Modifications

The methods disclosed herein can further comprise identifying a cell having a modified HSD17B13 gene. Various methods can be used to identify cells having a targeted genetic modification, such as a deletion or an insertion. Such methods can comprise identifying one cell having the targeted genetic modification in the HSD17B13 gene. Screening can be done to identify such cells with modified genomic loci.

The screening step can comprise a quantitative assay for assessing modification of allele (MOA) (e.g., loss-of-allele (LOA) and/or gain-of-allele (GOA) assays) of a parental chromosome. For example, the quantitative assay can be carried out via a quantitative PCR, such as a real-time PCR (qPCR). The real-time PCR can utilize a first primer set that recognizes the target genomic locus and a second primer set that recognizes a non-targeted reference locus. The primer set can comprise a fluorescent probe that recognizes the amplified sequence. The loss-of-allele (LOA) assay inverts the conventional screening logic and quantifies the number of copies of the native locus to which the mutation was directed. In a correctly targeted cell clone, the LOA assay detects one of the two native alleles (for genes not on the X or Y chromosome), the other allele being disrupted by the targeted modification. The same principle can be applied in reverse as a gain-of-allele (GOA) assay to quantify the copy number of the inserted targeting vector. For example, the combined use of GOA and LOA assays will reveal a correctly targeted heterozygous clone as having lost one copy of the native target gene and gained one copy of the drug resistance gene or other inserted marker.

As an example, quantitative polymerase chain reaction (qPCR) can be used as the method of allele quantification, but any method that can reliably distinguish the difference between zero, one, and two copies of the target gene or between zero, one, and two copies of the nucleic acid insert can be used to develop a MOA assay. For example, TAQMAN® can be used to quantify the number of copies of a DNA template in a genomic DNA sample, especially by comparison to a reference gene (see, e.g., U.S. Pat. No. 6,596,541, herein incorporated by reference in its entirety for all purposes). The reference gene is quantitated in the same genomic DNA as the target gene(s) or locus(loci). Therefore, two TAQMAN® amplifications (each with its respective probe) are performed. One TAQMAN® probe determines the "Ct" (Threshold Cycle) of the reference gene, while the other probe determines the Ct of the region of the targeted gene(s) or locus(loci) which is replaced by successful targeting (i.e., a LOA assay). The Ct is a quantity that reflects the amount of starting DNA for each of the TAQMAN® probes, i.e. a less abundant sequence requires more cycles of PCR to reach the threshold cycle. Decreasing by half the number of copies of the template sequence for a TAQMAN® reaction will result in an increase of about one Ct unit. TAQMAN® reactions in cells where one allele of the target gene(s) or locus(loci) has been replaced by homologous recombination will result in an increase of one Ct for the target TAQMAN® reaction without an increase in the Ct for the reference gene when compared to DNA from non-targeted cells. For a GOA assay, another TAQMAN® probe can be used to determine the Ct of the nucleic acid insert that is replacing the targeted gene(s) or locus(loci) by successful targeting.

Other examples of suitable quantitative assays include fluorescence-mediated in situ hybridization (FISH), comparative genomic hybridization, isothermic DNA amplification, quantitative hybridization to an immobilized probe(s), INVADER® Probes, TAQMAN® Molecular Beacon probes, or ECLIPSE™ probe technology (see, e.g., US 2005/0144655, herein incorporated by reference in its entirety for all purposes). Conventional assays for screening for targeted modifications, such as long-range PCR, Southern blotting, or Sanger sequencing, can also be used. Such assays typically are used to obtain evidence for a linkage between the inserted targeting vector and the targeted genomic locus. For example, for a long-range PCR assay, one primer can recognize a sequence within the inserted DNA while the other recognizes a target genomic locus sequence beyond the ends of the targeting vector's homology arms.

Next generation sequencing (NGS) can also be used for screening. Next-generation sequencing can also be referred to as "NGS" or "massively parallel sequencing" or "high throughput sequencing." In the methods disclosed herein, it is not necessary to screen for targeted cells using selection markers. For example, the MOA and NGS assays described herein can be relied on without using selection cassettes.

B. Methods of Altering Expression of HSD17B13 Nucleic Acids

Various methods are provided for altering expression of nucleic acids encoding HSD17B13 proteins. In some methods, expression is altered through cleavage with a nuclease agent to cause disruption of the nucleic acid encoding the HSD17B13 protein, as described in further detail elsewhere herein. In some methods, expression is altered through use of a DNA-binding protein fused or linked to a transcription activation domain or a transcription repression domain. In some methods, expression is altered through use of RNA interference compositions, such as antisense RNA, shRNA, or siRNA.

In one example, expression of an HSD17B13 gene or a nucleic acid encoding an HSD17B13 protein can be modified by contacting a cell or the genome within a cell with a nuclease agent that induces one or more nicks or double-strand breaks at a target sequence at a target genomic locus within the HSD17B13 gene or nucleic acid encoding an HSD17B13 protein. Such cleavage can result in disruption of expression of the HSD17B13 gene or nucleic acid encoding an HSD17B13 protein. For example, the nuclease target sequence can include or be proximate to the start codon of an HSD17B13 gene. For example, the target sequence can be within about 10, 20, 30, 40, 50, 100, 200, 300, 400, 500, or 1,000 nucleotides of the start codon, and cleavage by the nuclease agent can disrupt the start codon. As another example, two or more nuclease agents can be used, each targeting a nuclease target sequence including or proximate to the start codon. As another example, two nuclease agents can be used, one targeting a nuclease target sequence including or proximate to the start codon, and one targeting a nuclease target sequence including or proximate to the stop codon, wherein cleavage by the nuclease agents can result in deletion of the coding region between the two nuclease target sequences. As yet another example, three or more nuclease agents can be used, with one or more (e.g., two) targeting nuclease target sequences including or proximate to the start codon, and one or more (e.g., two) targeting nuclease target sequences including or proximate to the stop codon, wherein cleavage by the nuclease agents can result in deletion of the coding region between the nuclease target sequences including or proximate to the start codon and the nuclease target sequence including or proximate to the stop codon. Other examples of modifying an HSD17B13 gene or a nucleic acid encoding an HSD17B13 protein are disclosed elsewhere herein.

In another example, expression of an HSD17B13 gene or a nucleic acid encoding an HSD17B13 protein can be modified by contacting a cell or the genome within a cell with a DNA-binding protein that binds to a target genomic locus within the HSD17B13 gene. The DNA-binding protein can be, for example, a nuclease-inactive Cas protein fused to a transcriptional activator domain or a transcriptional repressor domain. Other examples of DNA-binding proteins include zinc finger proteins fused to a transcriptional activator domain or a transcriptional repressor domain, or Transcription Activator-Like Effector (TALE) proteins fused to a transcriptional activator domain or a transcriptional repressor domain. Examples of such proteins are disclosed elsewhere herein. For example, in some methods, a transcriptional repressor can be used to decrease expression of a wild type HSD17B13 gene or an HSD17B13 gene that is not the rs72613567 variant (e.g., to decrease expression of HSD17B13 Transcript or Isoform A). Likewise, in some methods, a transcriptional activator can be used to increase expression of an HSD17B13 gene rs72613567 variant gene (e.g., to increase expression of HSD17B13 Transcript or Isoform D).

The target sequence (e.g., guide RNA target sequence) for the DNA-binding protein can be anywhere within the HSD17B13 gene or a nucleic acid encoding an HSD17B13 protein suitable for altering expression. As one example, the target sequence can be within a regulatory element, such as an enhancer or promoter, or can be in proximity to a regulatory element. For example, the target sequence can include or be proximate to the start codon of an HSD17B13 gene. For example, the target sequence can be within about 10, 20, 30, 40, 50, 100, 200, 300, 400, 500, or 1,000 nucleotides of the start codon.

In another example, antisense molecules can be used to alter expression of an HSD17B13 gene or a nucleic acid encoding an HSD17B13 protein. Examples of antisense molecules include antisense RNAs, small interfering RNAs (siRNAs), and short hairpin RNAs (shRNAs). Such antisense RNAs, siRNAs, or shRNAs can be designed to target any region of an mRNA. For example, the antisense RNAs, siRNAs, or shRNAs can be designed to target a region unique to one or more of the HSD17B13 transcripts disclosed herein, or a region common to one or more of the HSD17B13 transcripts disclosed herein. Examples of nucleic acids hybridizing to cDNAs and variant HSD17B13 transcripts are disclosed in more detail elsewhere herein. For example, the antisense RNA, siRNA, or shRNA can hybridize to a sequence within SEQ ID NO: 4 (HSD17B13 Transcript A). Optionally, the antisense RNA, siRNA, or shRNA can decrease expression of HSD17B13 Transcript Ain a cell. Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the antisense RNA, siRNA, or shRNA hybridizes to a sequence within exon 7 or a sequence spanning the exon 6-exon 7 boundary of SEQ ID NO: 4 (HSD17B13 Transcript A).

As another example, the antisense RNA, siRNA, or shRNA can hybridize to a sequence within SEQ ID NO: 7 (HSD17B13 Transcript D). Optionally, the antisense RNA, siRNA, or shRNA can decrease expression of HSD17B13 Transcript D in a cell. Optionally, the antisense RNA, siRNA, or shRNA hybridizes to a sequence present in SEQ ID NO: 7 (HSD17B13 Transcript D) that is not present in SEQ ID NO: 4 (HSD17B13 Transcript A). Optionally, the antisense RNA, siRNA, or shRNA hybridizes to a sequence within exon 7 or a sequence spanning the exon 6-exon 7 boundary of SEQ ID NO: 7 (HSD17913 Transcript D).

C. Introducing Nucleic Acids and Proteins into Cells

The nucleic acids and proteins disclosed herein can be introduced into a cell by any means. "Introducing" includes presenting to the cell the nucleic acid or protein in such a manner that the sequence gains access to the interior of the cell. The introducing can be accomplished by any means, and one or more of the components (e.g., two of the components, or all of the components) can be introduced into the cell simultaneously or sequentially in any combination. For example, an exogenous donor sequence can be introduced prior to the introduction of a nuclease agent, or it can be introduced following introduction of nuclease agent (e.g., the exogenous donor sequence can be administered about 1, 2, 3, 4, 8, 12, 24, 36, 48, or 72 hours before or after introduction of the nuclease agent). See, e.g., US 2015/0240263 and US 2015/0110762, each of which is herein incorporated by reference in its entirety for all purposes. Contacting the genome of a cell with a nuclease agent or exogenous donor sequence can comprise introducing one or more nuclease agents or nucleic acids encoding nuclease agents (e.g., one or more Cas proteins or nucleic acids encoding one or more Cas proteins, and one or more guide RNAs or nucleic acids encoding one or more guide RNAs (i.e., one or more CRISPR RNAs and one or more tracrRNAs)) and/or one or more exogenous donor sequences into the cell. Contacting the genome of cell (i.e., contacting a cell) can comprise introducing only one of the above components, one or more of the components, or all of the components into the cell.

A nuclease agent can be introduced into the cell in the form of a protein or in the form of a nucleic acid encoding the nuclease agent, such as an RNA (e.g., messenger RNA (mRNA)) or DNA. When introduced in the form of a DNA, the DNA can be operably linked to a promoter active in the cell. Such DNAs can be in one or more expression constructs.

For example, a Cas protein can be introduced into the cell in the form of a protein, such as a Cas protein complexed with a gRNA, or in the form of a nucleic acid encoding the Cas protein, such as an RNA (e.g., messenger RNA (mRNA)) or DNA. A guide RNA can be introduced into the cell in the form of an RNA or in the form of a DNA encoding the guide RNA. When introduced in the form of a DNA, the DNA encoding the Cas protein and/or the guide RNA can be operably linked to a promoter active in the cell. Such DNAs can be in one or more expression constructs. For example, such expression constructs can be components of a single nucleic acid molecule. Alternatively, they can be separated in any combination among two or more nucleic acid molecules (i.e., DNAs encoding one or more CRISPR RNAs, DNAs encoding one or more tracrRNAs, and DNA encoding a Cas protein can be components of separate nucleic acid molecules).

In some methods, DNA encoding a nuclease agent (e.g., a Cas protein and a guide RNA) and/or DNA encoding an exogenous donor sequence can be introduced into a cell via DNA minicircles. See, e.g., WO 2014/182700, herein incorporated by reference in its entirety for all purposes. DNA minicircles are supercoiled DNA molecules that can be used for non-viral gene transfer that have neither an origin of replication nor an antibiotic selection marker. Thus, DNA minicircles are typically smaller in size than plasmid vector. These DNAs are devoid of bacterial DNA, and thus lack the unmethylated CpG motifs found in bacterial DNA.

The methods provided herein do not depend on a particular method for introducing a nucleic acid or protein into the cell, only that the nucleic acid or protein gains access to the interior of a least one cell. Methods for introducing nucleic acids and proteins into various cell types are known and include, for example, stable transfection methods, transient transfection methods, and virus-mediated methods.

Transfection protocols as well as protocols for introducing nucleic acids or proteins into cells may vary. Non-limiting transfection methods include chemical-based transfection methods using liposomes; nanoparticles; calcium phosphate (Graham et al. (1973) *Virology* 52 (2): 456-67, Bacchetti et al. (1977) *Proc. Nall. Acad. Sci. USA* 74 (4): 1590-4, and Kriegler, M (1991). Transfer and Expression: A Laboratory Manual. New York: W. H. Freeman and Company. pp. 96-97); dendrimers; or cationic polymers such as DEAE-dextran or polyethylenimine. Non-chemical methods include electroporation, Sono-poration, and optical transfection. Particle-based transfection includes the use of a gene gun, or magnet-assisted transfection (Bertram (2006) *Current Pharmaceutical Biotechnology* 7, 277-28). Viral methods can also be used for transfection.

Introduction of nucleic acids or proteins into a cell can also be mediated by electroporation, by intracytoplasmic injection, by viral infection, by adenovirus, by adeno-associated virus, by lentivirus, by retrovirus, by transfection, by lipid-mediated transfection, or by nucleofection. Nucleofection is an improved electroporation technology that enables nucleic acid substrates to be delivered not only to the cytoplasm but also through the nuclear membrane and into the nucleus. In addition, use of nucleofection in the methods disclosed herein typically requires much fewer cells than regular electroporation (e.g., only about 2 million compared with 7 million by regular electroporation). In one example, nucleofection is performed using the LONZA® NUCLEOFECTOR™ system.

Introduction of nucleic acids or proteins into a cell can also be accomplished by microinjection. Microinjection of an mRNA is preferably into the cytoplasm (e.g., to deliver mRNA directly to the translation machinery), while microinjection of a protein or a DNA encoding a DNA encoding a Cas protein is preferably into the nucleus. Alternatively, microinjection can be carried out by injection into both the nucleus and the cytoplasm: a needle can first be introduced into the nucleus and a first amount can be injected, and while removing the needle from the cell a second amount can be injected into the cytoplasm. If a nuclease agent protein is injected into the cytoplasm, the protein preferably comprises a nuclear localization signal to ensure delivery to the nucleus/pronucleus. Methods for carrying out microinjection are well known. See, e.g., Nagy et al. (Nagy A, Gertsenstein M, Vintersten K, Behringer R., 2003, Manipulating the Mouse Embryo. Cold Spring Harbor, New York: Cold Spring Harbor Laboratory Press); Meyer et al. (2010) *Proc. Nall. Acad. Sci. USA* 107:15022-15026 and Meyer et al. (2012) *Proc. Natl. Acad. Sci. USA* 109:9354-9359.

Other methods for introducing nucleic acid or proteins into a cell can include, for example, vector delivery, particle-mediated delivery, exosome-mediated delivery, lipid-nanoparticle-mediated delivery, cell-penetrating-peptide-mediated delivery, or implantable-device-mediated delivery. Methods of administering nucleic acids or proteins to a subject to modify cells in vivo are disclosed elsewhere herein.

Introduction of nucleic acids and proteins into cells can also be accomplished by hydrodynamic delivery (HDD). Hydrodynamic delivery has emerged as a near-perfect method for intracellular DNA delivery in vivo. For gene delivery to parenchymal cells, only essential DNA sequences need to be injected via a selected blood vessel, eliminating safety concerns associated with current viral and synthetic vectors. When injected into the bloodstream, DNA is capable of reaching cells in the different tissues accessible to the blood. Hydrodynamic delivery employs the force generated by the rapid injection of a large volume of solution into the incompressible blood in the circulation to overcome the physical barriers of endothelium and cell membranes that prevent large and membrane-impermeable compounds from entering parenchymal cells. In addition to the delivery of DNA, this method is useful for the efficient intracellular delivery of RNA, proteins, and other small compounds in vivo. See, e.g., Bonamassa et al. (2011) *Pharm. Res.* 28(4): 694-701, herein incorporated by reference in its entirety for all purposes.

Other methods for introducing nucleic acid or proteins into a cell can include, for example, vector delivery, particle-mediated delivery, exosome-mediated delivery, lipid-nanoparticle-mediated delivery, cell-penetrating-peptide-mediated delivery, or implantable-device-mediated delivery. As specific examples, a nucleic acid or protein can be introduced into a cell in a carrier such as a poly(lactic acid) (PLA) microsphere, a poly(D,L-lactic-coglycolic-acid) (PLGA) microsphere, a liposome, a micelle, an inverse micelle, a lipid cochleate, or a lipid microtubule.

The introduction of nucleic acids or proteins into the cell can be performed one time or multiple times over a period of time. For example, the introduction can be performed at least two times over a period of time, at least three times over a period of time, at least four times over a period of time, at least five times over a period of time, at least six times over a period of time, at least seven times over a period of time, at least eight times over a period of time, at least nine times over a period of times, at least ten times over a period of time, at least eleven times, at least twelve times over a period of time, at least thirteen times over a period of time, at least fourteen times over a period of time, at least fifteen times over a period of time, at least sixteen times over a period of time, at least seventeen times over a period of time, at least eighteen times over a period of time, at least nineteen times over a period of time, or at least twenty times over a period of time.

In some cases, the cells employed in the methods and compositions have a DNA construct stably incorporated into their genome. In such cases, the contacting can comprise providing a cell with the construct already stably incorporated into its genome. For example, a cell employed in the methods disclosed herein may have a preexisting Cas-encoding gene stably incorporated into its genome (i.e., a Cas-ready cell). “Stably incorporated” or “stably introduced” or “stably integrated” includes the introduction of a polynucleotide into the cell such that the nucleotide sequence integrates into the genome of the cell and is capable of being inherited by progeny thereof. Any protocol may be used for the stable incorporation of the DNA constructs or the various components of the targeted genomic integration system.

D. Nuclease Agents and DNA-Binding Proteins

Any nuclease agent that induces a nick or double-strand break into a desired target sequence or any DNA-binding protein that binds to a desired target sequence can be used in the methods and compositions disclosed herein. A naturally occurring or native nuclease agent can be employed so long as the nuclease agent induces a nick or double-strand break in a desired target sequence. Likewise, a naturally occurring or native DNA-binding protein can be employed so long as the DNA-binding protein binds to the desired target sequence. Alternatively, a modified or engineered nuclease agent or DNA-binding protein can be employed. An “engineered nuclease agent or DNA-binding protein” includes a nuclease agent or DNA-binding protein that is engineered (modified or derived) from its native form to specifically recognize a desired target sequence. Thus, an engineered nuclease agent or DNA-binding protein can be derived from a native, naturally occurring nuclease agent or DNA-binding protein or it can be artificially created or synthesized. The engineered nuclease agent or DNA-binding protein can recognize a target sequence, for example, wherein the target sequence is not a sequence that would have been recognized by a native (non-engineered or non-modified) nuclease agent or DNA-binding protein. The modification of the nuclease agent or DNA-binding protein can be as little as one amino acid in a protein cleavage agent or one nucleotide in a nucleic acid cleavage agent. Producing a nick or double-strand break in a target sequence or other DNA can be referred to herein as “cutting” or “cleaving” the target sequence or other DNA.

Active variants and fragments of nuclease agents or DNA-binding proteins (i.e., an engineered nuclease agent or DNA-binding protein) are also provided. Such active variants can comprise at least 65%, 70%, 75%, 80%, 85%, 90%, 91%, 92%, 93%, 94%, 95%, 96%, 97%, 98%, 99% or more sequence identity to the native nuclease agent or DNA-binding protein, wherein the active variants retain the ability to cut at a desired target sequence and hence retain nick or double-strand-break-inducing activity or retain the ability to bind a desired target sequence. For example, any of the nuclease agents described herein can be modified from a native endonuclease sequence and designed to recognize and induce a nick or double-strand break at a target sequence that was not recognized by the native nuclease agent. Thus, some engineered nucleases have a specificity to induce a nick or double-strand break at a target sequence that is different from the corresponding native nuclease agent target sequence. Assays for nick or double-strand-break-inducing activity are known and generally measure the overall activity and specificity of the endonuclease on DNA substrates containing the target sequence.

The term “target sequence for a nuclease agent” includes a DNA sequence at which a nick or double-strand break is induced by a nuclease agent. Likewise, the term “target sequence for a DNA-binding protein” includes a DNA sequence to which a DNA-binding protein will bind. The target sequence can be endogenous (or native) to the cell or the target sequence can be exogenous to the cell. A target sequence that is exogenous to the cell is not naturally occurring in the genome of the cell. The target sequence can also exogenous to the polynucleotides of interest that one desires to be positioned at the target locus. In some cases, the target sequence is present only once in the genome of the host cell.

Active variants and fragments of the exemplified target sequences are also provided. Such active variants can comprise at least 65%, 70%, 75%, 80%, 85%, 90%, 91%, 92%, 93%, 94%, 95%, 96%, 97%, 98%, 99% or more sequence identity to the given target sequence, wherein the active variants retain biological activity and hence are capable of being recognized and cleaved by a nuclease agent in a sequence-specific manner. Assays to measure the double-strand break of a target sequence by a nuclease agent are known (e.g., TAQMAN® qPCR assay, Frendewey et al. (2010) *Methods in Enzymology* 476:295-307, herein incorporated by reference in its entirety for all purposes).

The length of the target sequence can vary, and includes, for example, target sequences that are about 30-36 bp for a zinc finger protein or zinc finger nuclease (ZFN) pair (i.e., about 15-18 bp for each ZFN), about 36 bp for a Transcription Activator-Like Effector (TALE) protein or Transcription Activator-Like Effector Nuclease (TALEN), or about 20 bp for a CRISPR/Cas9 guide RNA.

The target sequence of the DNA-binding protein or nuclease agent can be positioned anywhere in or near the target genomic locus. The target sequence can be located within a coding region of a gene (e.g., the HSD17B13 gene), or within regulatory regions that influence the expression of the gene. A target sequence of the DNA-binding protein or nuclease agent can be located in an intron, an exon, a promoter, an enhancer, a regulatory region, or any non-protein coding region.

One type of DNA-binding protein that can be employed in the various methods and compositions disclosed herein is a Transcription Activator-Like Effector (TALE). A TALE can be fused or linked to, for example, an epigenetic modification domain, a transcriptional activation domain, or a transcriptional repressor domain. Examples of such domains are described with respect to Cas proteins, below, and can also be found, for example, in WO 2011/145121, herein incorporated by reference in its entirety for all purposes. Correspondingly, one type of nuclease agent that can be employed in the various methods and compositions disclosed herein is a Transcription Activator-Like Effector Nuclease (TALEN). TAL effector nucleases are a class of sequence-specific nucleases that can be used to make double-strand breaks at specific target sequences in the genome of a prokaryotic or eukaryotic organism. TAL effector nucleases are created by fusing a native or engineered transcription activator-like (TAL) effector, or functional part thereof, to the catalytic domain of an endonuclease such as FokI. The unique, modular TAL effector DNA binding domain allows for the design of proteins with potentially any given DNA recognition specificity. Thus, the DNA binding domains of the TAL effector nucleases can be engineered to recognize specific DNA target sites and thus, used to make double-strand breaks at desired target sequences. See WO 2010/079430; Morbitzer et al. (2010) *Proc. Natl. Acad. Sci. U.S.A.* 107(50:21617-21622; Scholze & Boch (2010) *Virulence* 1:428-432; Christian et al. (2010) *Genetics* 186:757-761; Li et al. (2011) *Nucleic Acids Res.* 39(1);359-372; and Miller et al. (2011) *Nature Biotechnology* 29:143-148, each of which is herein incorporated by reference in its entirety for all purposes.

Examples of suitable TAL nucleases, and methods for preparing suitable TAL nucleases, are disclosed, e.g., in US 2011/0239315 A1, US 2011/0269234 A1, US 2011/0145940 A1, US 2003/0232410 A1, US 2005/0208489 A1, US 2005/0026157 A1, US 2005/0064474 A1, US 2006/0188987 A1, and US 2006/0063231 A1, each of which is herein incorporated by reference in its entirety for all purposes. In various embodiments, TAL effector nucleases are engineered that cut in or near a target nucleic acid sequence in, for example, a genomic locus of interest, wherein the target nucleic acid sequence is at or near a sequence to be modified by a an exogenous donor sequence. The TAL nucleases suitable for use with the various methods and compositions provided herein include those that are specifically designed to bind at or near target nucleic acid sequences to be modified by exogenous donor sequences as described elsewhere herein.

In some TALENs, each monomer of the TALEN comprises 33-35 TAL repeats that recognize a single base pair via two hypervariable residues. In some TALENs, the nuclease agent is a chimeric protein comprising a TAL-repeat-based DNA binding domain operably linked to an independent nuclease such as a Fold endonuclease. For example, the nuclease agent can comprise a first TAL-repeat-based DNA binding domain and a second TAL-repeat-based DNA binding domain, wherein each of the first and the second TAL-repeat-based DNA binding domains is operably linked to a FokI nuclease, wherein the first and the second TAL-repeat-based DNA binding domain recognize two contiguous target DNA sequences in each strand of the target DNA sequence separated by a spacer sequence of varying length (12-20 bp), and wherein the Fold nuclease subunits dimerize to create an active nuclease that makes a double strand break at a target sequence.

Another example of a DNA-binding protein is a zinc finger protein. Such zinc finger proteins can be linked or fused to, for example, an epigenetic modification domain, a transcriptional activation domain, or a transcriptional repressor domain. Examples of such domains are described with respect to Cas proteins, below, and can also be found, for example, in WO 2011/145121, herein incorporated by reference in its entirety for all purposes. Correspondingly, another example of a nuclease agent that can be employed in the various methods and compositions disclosed herein is a zinc-finger nuclease (ZFN). In some ZFNs, each monomer of the ZFN comprises three or more zinc finger-based DNA binding domains, wherein each zinc finger-based DNA binding domain binds to a 3 bp subsite. In other ZFNs, the ZFN is a chimeric protein comprising a zinc finger-based DNA binding domain operably linked to an independent nuclease such as a FokI endonuclease. For example, the nuclease agent can comprise a first ZFN and a second ZFN, wherein each of the first ZFN and the second ZFN is operably linked to a FokI nuclease subunit, wherein the first and the second ZFN recognize two contiguous target DNA sequences in each strand of the target DNA sequence separated by about 5-7 bp spacer, and wherein the FokI nuclease subunits dimerize to create an active nuclease that makes a double strand break. See, e.g., US 2006/0246567; US 2008/0182332; US 2002/0081614; US 2003/0021776; WO 2002/057308 A2; US 2013/0123484; US 2010/0291048; WO 2011/017293 A2; and Gaj et al. (2013) *Trends in Biotechnology* 31(7):397-405, each of which is herein incorporated by reference in its entirety for all purposes.

Other suitable DNA-binding proteins and nuclease agents for use in the methods and compositions described herein include CRISPR-Cas systems, which are described elsewhere herein.

The DNA-binding protein or nuclease agent may be introduced into the cell by any known means. A polypeptide encoding the DNA-binding protein or nuclease agent may be directly introduced into the cell. Alternatively, a polynucleotide encoding the DNA-binding protein or nuclease agent can be introduced into the cell. When a polynucleotide encoding the DNA-binding protein or nuclease agent is introduced into the cell, the DNA-binding protein or nuclease agent can be transiently, conditionally, or constitutively expressed within the cell. For example, the polynucleotide encoding the DNA-binding protein or nuclease agent can be contained in an expression cassette and be operably linked to a conditional promoter, an inducible promoter, a constitutive promoter, or a tissue-specific promoter. Such promoters are discussed in further detail elsewhere herein. Alternatively, the DNA-binding protein or nuclease agent can be introduced into the cell as an mRNA encoding a DNA-binding protein or a nuclease agent.

A polynucleotide encoding a DNA-binding protein or nuclease agent can be stably integrated in the genome of the cell and operably linked to a promoter active in the cell. Alternatively, a polynucleotide encoding a DNA-binding protein or nuclease agent can be in a targeting vector or in a vector or a plasmid that is separate from the targeting vector comprising the insert polynucleotide.

When the DNA-binding protein or nuclease agent is provided to the cell through the introduction of a polynucleotide encoding the DNA-binding protein or nuclease agent, such a polynucleotide encoding a DNA-binding protein or nuclease agent can be modified to substitute codons having a higher frequency of usage in the cell of interest, as compared to the naturally occurring polynucleotide sequence encoding the DNA-binding protein or nuclease agent. For example, the polynucleotide encoding the DNA-binding protein or nuclease agent can be modified to substitute codons having a higher frequency of usage in a given prokaryotic or eukaryotic cell of interest, including a bacterial cell, a yeast cell, a human cell, a non-human cell, a mammalian cell, a rodent cell, a mouse cell, a rat cell or any other host cell of interest, as compared to the naturally occurring polynucleotide sequence.

E. CRISPR-Cas Systems

The methods disclosed herein can utilize Clustered Regularly Interspersed Short Palindromic Repeats (CRISPR)/CRISPR-associated (Cas) systems or components of such systems to modify a genome within a cell. CRISPR-Cas systems include transcripts and other elements involved in the expression of, or directing the activity of, Cas genes. A CRISPR-Cas system can be a type I, a type II, or a type III system. Alternatively a CRISPR/Cas system can be, for example, a type V system (e.g., subtype V-A or subtype V-B). The methods and compositions disclosed herein can employ CRISPR-Cas systems by utilizing CRISPR complexes (comprising a guide RNA (gRNA) complexed with a Cas protein) for site-directed cleavage of nucleic acids.

The CRISPR-Cas systems used in the methods disclosed herein can be non-naturally occurring. A "non-naturally occurring" system includes anything indicating the involvement of the hand of man, such as one or more components of the system being altered or mutated from their naturally occurring state, being at least substantially free from at least one other component with which they are naturally associated in nature, or being associated with at least one other component with which they are not naturally associated. For example, non-naturally occurring CRISPR/Cas systems can employ CRISPR complexes comprising a gRNA and a Cas protein that do not naturally occur together, a Cas protein that does not occur naturally, or a gRNA that does not occur naturally.

(1) Cas Proteins and Polynucleotides Encoding Cas Proteins

Cas proteins generally comprise at least one RNA recognition or binding domain that can interact with guide RNAs (gRNAs, described in more detail below). Cas proteins can also comprise nuclease domains (e.g., DNase or RNase domains), DNA binding domains, helicase domains, protein-protein interaction domains, dimerization domains, and other domains. A nuclease domain possesses catalytic activity for nucleic acid cleavage, which includes the breakage of the covalent bonds of a nucleic acid molecule. Cleavage can produce blunt ends or staggered ends, and it can be single-stranded or double-stranded. For example, a wild type Cas9 protein will typically create a blunt cleavage product. Alternatively, a wild type Cpf1 protein (e.g., FnCpf1) can result in a cleavage product with a 5-nucleotide 5' overhang, with the cleavage occurring after the 18th base pair from the PAM sequence on the non-targeted strand and after the 23rd base on the targeted strand. A Cas protein can have full cleavage activity to create a double-strand break in the HSD17B13 gene (e.g., a double-strand break with blunt ends), or it can be a nickase that creates a single-strand break in the HSD17B13 gene.

Examples of Cas proteins include Cas1, Cas1B, Cas2, Cas3, Cas4, Cas5, Cas5e (CasD), Cas6, Cas6e, Cas6f, Cas7, Cas8a1, Cas8a2, Cas8b, Cas8c, Cas9 (Csn1 or Csx12), Cas10, Cas10d, CasF, CasG, CasH, Csyl, Csy2, Csy3, Cse1 (CasA), Cse2 (CasB), Cse3 (CasE), Cse4 (CasC), Csc1, Csc2, Csa5, Csn2, Csm2, Csm3, Csm4, Csm5, Csm6, Cmr1, Cmr3, Cmr4, Cmr5, Cmr6, Csb1, Csb2, Csb3, Csx17, Csx14, Csx10, Csx16, CsaX, Csx3, Csx1, Csx15, Csf1, Csf2, Csf3, Csf4, and Cu 1966, and homologs or modified versions thereof.

An exemplary Cas protein is a Cas9 protein or a protein derived from a Cas9 protein from a type 11 CRISPR/Cas system. Cas9 proteins are from a type II CRISPR/Cas system and typically share four key motifs with a conserved architecture. Motifs 1, 2, and 4 are RuvC-like motifs, and motif 3 is an HNH motif. Exemplary Cas9 proteins are from *Streptococcus pyogenes, Streptococcus thermophilus, Streptococcus* sp., *Staphylococcus aureus, Nocardiopsis dacsonvillei, Streptomyces pristinaespiralis, Streptomyces viridochromogenes, Streptomvices viridochromogenes, Streptosporangium roseum, Streptosporangium roseum, Alicyclobacillus acidocaldarius, Bacillus pseudomycoides, Bacillus selenitireducens, Exiguobacterium sibiricum, Lactobacillus delbrueckii, Lactobacillus salivarius*, Micrascilla marina, Burkholderiales bacterium, *Polaromonas naphthalenivorans, Polaromonas* sp., *Crocosphaera watsonii*, Cyanothece sp., Microcyslis *aeruginosa*, Synechococcus sp., Acetohalobium arabaticum, Ammonifex degensii, Caldicelulosiruptor becscii, Candidatus Desul forudis, *Clostridium botulinum, Clostridium difcile, Finegoldia magna, Natranaerobius thermophilus*, Pelotomaculum thermopropionicum, Acidithiobacillus caldus, Acidithiohacillus *ferrooxidans, Allochromatium vinosum, Marinobacter* sp., Nitrosococcus *halophilus, Nitrosococcus watsoni, Pseudoalteromonas haloplanktis*, Ktedonobacter racemifer, Methanohalohium evestigatum, *Anabaena variabilis, Nodularia spumigena, Nostoc* sp., Arthrospira maxima, Arthrospira *platensis*, Arthrospira sp., Lyngbya.sp., ivficrocoleus chthonoplastes, Oscillatoria sp., Petrotoga *mobilis, Thermosipho africanus*, or Acaryochloris marina. Additional examples of the Cas9 family members are described in WO 2014/131833, herein incorporated by reference in its entirety for all purposes. Cas9 from *S. pyogenes* (SpCas9) (assigned SwissProt accession number Q99ZW2) is an exemplary Cas9 protein. Cas9 from *S. aureus* (SaCas9) (assigned UniProt accession number J7RUA5) is another exemplary Cas9 protein.

Another example of a Cas protein is a Cpf1 (CRISPR from *Prevotella* and *Francisella* 1) protein. Cpf1 is a large protein (about 1300 amino acids) that contains a RuvC-like nuclease domain homologous to the corresponding domain of Cas9 along with a counterpart to the characteristic arginine-rich cluster of Cas9. However, Cpf1 lacks the HNH nuclease domain that is present in Cas9 proteins, and the RuvC-like domain is contiguous in the Cpf1 sequence, in contrast to Cas9 where it contains long inserts including the HNH domain. See, e.g., Zetsche et al. (2015) *Cell* 163(3): 759-771, herein incorporated by reference in its entirety for all purposes. Exemplary Cpf1 proteins are from *Francisella tularensis* 1, *Francisella tularensis* subsp. *novicida, Prevotella albensis*, Lachnospiraceae bacterium MC201 7 1, Butyrivihrio *proteoclasticus*, Peregrinibacteria bacterium GW2011 GWA2 33 10, Parcubacteria bacterium GW2011 GWC2 44 17, Smithella sp. SCADC, Acidaminococcus sp.

BV3L6, Lachnospiraceae bacterium M42020, Candidatus Methanoplasma *termitum, Eubacterium eligens, Moraxella* bovoculi 237, Leptospira inadai, Lachnospiraceae bacterium ND2006, *Porphyromonas* crevioricanis 3, *Prevotella disiens*, and *Porphyromonas macacae*. Cpf1 from *Francisella novicida* U112 (FnCpf1; assigned Uni Prot accession number A0Q7Q2) is an exemplary Cpf1 protein.

Cas proteins can be wild type proteins (i.e., those that occur in nature), modified Cas proteins (i.e., Cas protein variants), or fragments of wild type or modified Cas proteins. Cas proteins can also be active variants or fragments with respect to catalytic activity of wild type or modified Cas proteins. Active variants or fragments with respect to catalytic activity can comprise at least 80%, 85%, 90%, 91%, 92%, 93%, 94%, 95%, 96%, 97%, 98%, 99% or more sequence identity to the wild type or modified Cas protein or a portion thereof, wherein the active variants retain the ability to cut at a desired cleavage site and hence retain nick-inducing or double-strand-break-inducing activity. Assays for nick-inducing or double-strand-break-inducing activity are known and generally measure the overall activity and specificity of the Cas protein on DNA substrates containing the cleavage site.

Cas proteins can be modified to increase or decrease one or more of nucleic acid binding affinity, nucleic acid binding specificity, and enzymatic activity. Cas proteins can also be modified to change any other activity or property of the protein, such as stability. For example, one or more nuclease domains of the Cas protein can be modified, deleted, or inactivated, or a Cas protein can be truncated to remove domains that are not essential for the function of the protein or to optimize (e.g., enhance or reduce) the activity of the Cas protein.

Cas proteins can comprise at least one nuclease domain, such as a DNase domain. For example, a wild type Cpf1 protein generally comprises a RuvC-like domain that cleaves both strands of target DNA, perhaps in a dimeric configuration. Cas proteins can also comprise at least two nuclease domains, such as DNase domains. For example, a wild type Cas9 protein generally comprises a RuvC-like nuclease domain and an HNH-like nuclease domain. The RuvC and HNH domains can each cut a different strand of double-stranded DNA to make a double-stranded break in the DNA. See, e.g., Jinek et al. (2012) *Science* 337:816-821, herein incorporated by reference in its entirety for all purposes.

One or more of the nuclease domains can be deleted or mutated so that they are no longer functional or have reduced nuclease activity. For example, if one of the nuclease domains is deleted or mutated in a Cas9 protein, the resulting Cas9 protein can be referred to as a nickase and can generate a single-strand break at a guide RNA target sequence within a double-stranded DNA but not a double-strand break (i.e., it can cleave the complementary strand or the non-complementary strand, but not both). If both of the nuclease domains are deleted or mutated, the resulting Cas protein (e.g., Cas9) will have a reduced ability to cleave both strands of a double-stranded DNA (e.g., a nuclease-null or nuclease-inactive Cas protein, or a catalytically dead Cas protein (dCas)). An example of a mutation that converts Cas9 into a nickase is a D10A (aspartate to alanine at position 10 of Cas9) mutation in the RuvC domain of Cas9 from *S. pyogenes*. Likewise, H939A (histidine to alanine at amino acid position 839) or H840A (histidine to alanine at amino acid position 840) in the HNH domain of Cas9 from *S. pyogenes* can convert the Cas9 into a nickase. Other examples of mutations that convert Cas9 into a nickase include the corresponding mutations to Cas9 from *S. thermophilus*. See, e.g., Sapranauskas et al. (2011) Nucleic Acids Research 39:9275-9282 and WO 2013/141680, each of which is herein incorporated by reference in its entirety for all purposes. Such mutations can be generated using methods such as site-directed mutagenesis, PCR-mediated mutagenesis, or total gene synthesis. Examples of other mutations creating nickases can be found, for example, in WO 2013/176772 and WO 2013/142578, each of which is herein incorporated by reference in its entirety for all purposes.

Cas proteins (e.g., nuclease-active Cas proteins or nuclease-inactive Cas proteins) can also be operably linked to heterologous polypeptides as fusion proteins. For example, a Cas protein can be fused to a cleavage domain, an epigenetic modification domain, a transcriptional activation domain, or a transcriptional repressor domain. See WO 2014/089290, herein incorporated by reference in its entirety for all purposes. Examples of transcriptional activation domains include a herpes simplex virus VP16 activation domain, VP64 (which is a tetrameric derivative of VP 16), a NFκB p65 activation domain, p53 activation domains 1 and 2, a CREB (cAMP response element binding protein) activation domain, an E2A activation domain, and an NFAT (nuclear factor of activated T-cells) activation domain. Other examples include activation domains from Oct1, Oct-2A, SP1, AP-2, CTF 1, P300, CBP, PCAF, SRC 1, PvALF, ERF-2, OsGAI, HALF-1, Cl, AP1, ARF-5, ARF-6, ARF-7, ARF-8, CPRFI, CPRF4, MYC-RP/GP, TRAB IPC4, and HSF 1. See, e.g., US 2016/0237456, EP3045537, and WO 2011/145121, each of which is incorporated by reference in its entirety for all purposes. In some cases, a transcriptional activation system can be used comprising a dCas9-VP64 fusion protein paired with MS2-p65-HSF1. Guide RNAs in such systems can be designed with aptamer sequences appended to sgRNA tetraloop and stem-loop 2 designed to bind dimerized MS2 bacteriophage coat proteins. See, e.g., Konermann et al. (2015) Nature 517(7536):583-588, herein incorporated by reference in its entirety for all purposes. Examples of transcriptional repressor domains include inducible cAMP early repressor (ICER) domains, Kruppel-associated box A (KRAB-A) repressor domains, YY1 glycine rich repressor domains, Sp1-like repressors, E(spl) repressors, IκB repressor, and MeCP2. Other examples include transcriptional repressor domains from A/B, KOX, TGF-beta-inducible early gene (TIEG), v-erbA, SID, SID4X, MBD2, MBD3, DNMT1, DNMG3A, DNMT3B, Rb, ROM2, See, e.g., EP3045537 and WO 2011/145121, each of which is incorporated by reference in its entirety for all purposes. Cas proteins can also be fused to a heterologous polypeptide providing increased or decreased stability. The fused domain or heterologous polypeptide can be located at the N-terminus, the C-terminus, or internally within the Cas protein.

As one example, a Cas protein can be fused to a heterologous polypeptide that provides for subcellular localization. Such heterologous polypeptides can include, for example, one or more nuclear localization signals (NLS) such as the SV40 NLS for targeting to the nucleus, a mitochondria) localization signal for targeting to the mitochondria, an ER retention signal, and the like. See, e.g., Lange et al. (2007) *J. Biol. Chem.* 282:5101-5105, herein incorporated by reference in its entirety for all purposes. Such subcellular localization signals can be located at the N-terminus, the C-terminus, or anywhere within the Cas protein. An NLS can comprise a stretch of basic amino acids, and can be a monopartite sequence or a bipartite sequence.

Cas proteins can also be operably linked to a cell-penetrating domain. For example, the cell-penetrating domain can be derived from the HIV-1 TAT protein, the TLM cell-penetrating motif from human hepatitis B virus, MPG, Pep-1, VP22, a cell penetrating peptide from Herpes simplex virus, or a polyarginine peptide sequence. See, e.g., WO 2014/089290, herein incorporated by reference in its entirety for all purposes. The cell-penetrating domain can be located at the N-terminus, the C-terminus, or anywhere within the Cas protein.

Cas proteins can also be operably linked to a heterologous polypeptide for ease of tracking or purification, such as a fluorescent protein, a purification tag, or an epitope tag. Examples of fluorescent proteins include green fluorescent proteins (e.g., GFP, GFP-2, tagGFP, turboGFP, eGFP, Emerald, Azami Green, Monomeric Azami Green, CopGFP, AceGFP, ZsGreen1), yellow fluorescent proteins (e.g., YFP, eYFP, Citrine, Venus, YPet, PhiYFP, ZsYellow1), blue fluorescent proteins (e.g., eBFP, eBFP2, Azurite, mKalamal, GFPuv, Sapphire, T-sapphire), cyan fluorescent proteins (e.g., eCFP, Cerulean, CyPet, AmCyanl, Midoriishi-Cyan), red fluorescent proteins (e.g., mKate, mKate2, mPlum, DsRed monomer, mCherry, mRFP1, DsRed-Express, DsRed2, DsRed-Monomer, HcRed-Tandem, HcRedl, AsRed2, eqFP611, mRaspberry, mStrawberry, Jred), orange fluorescent proteins (e.g., mOrange, mKO, Kusabira-Orange, Monomeric Kusabira-Orange, mTangerine, tdTomato), and any other suitable fluorescent protein. Examples of tags include glutathione-S-transferase (GST), chitin binding protein (CBP), maltose binding protein, thioredoxin (TRX), poly(NANP), tandem affinity purification (TAP) tag, myc, AcV5, AU1, AUS, E, ECS, E2, FLAG, hemagglutinin (HA), nus, Softag 1, Softag 3, Strep, SBP, Glu-Glu, HSV, KT3, S, Si, 17, V5, VSV-G, histidine (His), biotin carboxyl carrier protein (BCCP), and calmodulin.

Cas proteins can also be tethered to exogenous donor sequences or labeled nucleic acids. Such tethering (i.e., physical linking) can be achieved through covalent interactions or noncovalent interactions, and the tethering can be direct (e.g., through direct fusion or chemical conjugation, which can be achieved by modification of cysteine or lysine residues on the protein or intein modification), or can be achieved through one or more intervening linkers or adapter molecules such as streptavidin or aptamers. See, e.g., Pierce et al. (2005) *Mini Rev. Med Chem.* 5(1):41-55; Duckworth et al. (2007) *Angew. Chem. In. Ed. Fungi.* 46(46):8819-8822; Schaeffer and Dixon (2009) *Australians J. (,hem.* 62(10): 1328-1332; Goodman et al. (2009) *Chembiochem.* 10(9): 1551-1557; and Khatwani et al. (2012) *Bioorg. Med. Chem.* 20(14):4532-4539, each of which is herein incorporated by reference in its entirety for all purposes. Noncovalent strategies for synthesizing protein-nucleic acid conjugates include biotin-streptavidin and nickel-histidine methods. Covalent protein-nucleic acid conjugates can be synthesized by connecting appropriately functionalized nucleic acids and proteins using a wide variety of chemistries. Some of these chemistries involve direct attachment of the oligonucleotide to an amino acid residue on the protein surface (e.g., a lysine amine or a cysteine thiol), while other more complex schemes require post-translational modification of the protein or the involvement of a catalytic or reactive protein domain. Methods for covalent attachment of proteins to nucleic acids can include, for example, chemical cross-linking of oligonucleotides to protein lysine or cysteine residues, expressed protein-ligation, chemoenzymatic methods, and the use of photoaptamers. The exogenous donor sequence or labeled nucleic acid can be tethered to the C-terminus, the N-terminus, or to an internal region within the Cas protein. Preferably, the exogenous donor sequence or labeled nucleic acid is tethered to the C-terminus or the N-terminus of the Cas protein. Likewise, the Cas protein can be tethered to the 5' end, the 3' end, or to an internal region within the exogenous donor sequence or labeled nucleic acid. That is, the exogenous donor sequence or labeled nucleic acid can be tethered in any orientation and polarity. Preferably, the Cas protein is tethered to the 5' end or the 3' end of the exogenous donor sequence or labeled nucleic acid.

Cas proteins can be provided in any form. For example, a Cas protein can be provided in the form of a protein, such as a Cas protein complexed with a gRNA. Alternatively, a Cas protein can be provided in the form of a nucleic acid encoding the Cas protein, such as an RNA (e.g., messenger RNA (mRNA)) or DNA. Optionally, the nucleic acid encoding the Cas protein can be codon optimized for efficient translation into protein in a particular cell or organism. For example, the nucleic acid encoding the Cas protein can be modified to substitute codons having a higher frequency of usage in a bacterial cell, a yeast cell, a human cell, a non human cell, a mammalian cell, a rodent cell, a mouse cell, a rat cell, or any other host cell of interest, as compared to the naturally occurring polynucleotide sequence. When a nucleic acid encoding the Cas protein is introduced into the cell, the Cas protein can be transiently, conditionally, or constitutively expressed in the cell.

Nucleic acids encoding Cas proteins can be stably integrated in the genome of the cell and operably linked to a promoter active in the cell. Alternatively, nucleic acids encoding Cas proteins can be operably linked to a promoter in an expression construct. Expression constructs include any nucleic acid constructs capable of directing expression of a gene or other nucleic acid sequence of interest (e.g., a Cas gene) and which can transfer such a nucleic acid sequence of interest to a target cell. For example, the nucleic acid encoding the Cas protein can be in a targeting vector comprising a nucleic acid insert and/or a vector comprising a DNA encoding a gRNA. Alternatively, it can be in a vector or plasmid that is separate from the targeting vector comprising the nucleic acid insert and/or separate from the vector comprising the DNA encoding the gRNA. Promoters that can be used in an expression construct include promoters active, for example, in one or more of a eukaryotic cell, a human cell, a non-human cell, a mammalian cell, a non-human mammalian cell, a rodent cell, a mouse cell, a rat cell, a hamster cell, a rabbit cell, a pluripotent cell, an embryonic stem (ES) cell, or a zygote. Such promoters can be, for example, conditional promoters, inducible promoters, constitutive promoters, or tissue-specific promoters. Optionally, the promoter can be a bidirectional promoter driving expression of both a Cas protein in one direction and a guide RNA in the other direction. Such bidirectional promoters can consist of (1) a complete, conventional, unidirectional Pol III promoter that contains 3 external control elements: a distal sequence element (DSE), a proximal sequence element (PSE), and a TATA box; and (2) a second basic Pol III promoter that includes a PSE and a TATA box fused to the 5' terminus of the DSE in reverse orientation. For example, in the H1 promoter, the DSE is adjacent to the PSE and the TATA box, and the promoter can be rendered bidirectional by creating a hybrid promoter in which transcription in the reverse direction is controlled by appending a PSE and TATA box derived from the U6 promoter. See, e.g., US 2016/0074535, herein incorporated by references in its entirety for all purposes. Use of a bidirectional promoter to express genes encoding a Cas protein and a guide RNA simultaneously allow for the generation of compact expression cassettes to facilitate delivery.

(2) Guide RNAs

A "guide RNA" or "gRNA" is an RNA molecule that binds to a Cas protein (e.g., Cas9 protein) and targets the Cas protein to a specific location within a target DNA (e.g., the HSD17B13 gene). In particular, disclosed herein are guide RNAs effective to direct a Cas enzyme to bind to or cleave an HSD17B13 locus or HSD17B13 gene. One exemplary guide RNA is a guide RNA effective to direct a Cas enzyme to bind to or cleave an HSD17B13 gene, wherein the guide RNA comprises a DNA-targeting segment that hybridizes to a guide RNA recognition sequence (i.e., targets a guide RNA target sequence) within the HSD17B13 gene that includes or is proximate to a position corresponding to position 12666 of SEQ ID NO: 2 when the HSD17B13 gene is optimally aligned with SEQ ID NO: 2. By target a guide RNA target sequence is meant hybridize to the complementary strand sequence that is the reverse complement of the guide RNA target sequence on the non-complementary strand. For example, the guide RNA target sequence can be within about 5, 10, 15, 20, 25, 30, 35, 40, 45, 50, 100, 200, 300, 400, 500, or 1,000 nucleotides of a position corresponding to position 12666 of SEQ ID NO: 2 when the HSD17B13 gene is optimally aligned with SEQ ID NO: 2. Other exemplary guide RNAs comprise a DNA-targeting segment that targets a guide RNA target sequence within the HSD17B13 gene that is within a region corresponding to exon 6 and/or intron 6 of SEQ CD NO: 2 when the HSD17B13 gene is optimally aligned with SEQ ID NO: 2. Other exemplary guide RNAs comprise a DNA-targeting segment that targets a guide RNA target sequence within the HSD17B13 gene that is within a region corresponding to exon 6 and/or intron 6 and/or exon 7 of SEQ ID NO: 2 when the HSD17B13 gene is optimally aligned with SEQ ID NO: 2. Other exemplary guide RNAs comprise a DNA-targeting segment that hybridizes to a guide RNA recognition sequence (i.e., targets a guide RNA target sequence) within the HSD17B13 gene that includes or is proximate to the start codon of the HSD17B13 gene or includes or is proximate to the stop codon of the HSD17B13 gene. For example, the guide RNA target sequence can be within about 5, 10, 15, 20, 25, 30, 35, 40, 45, 50, 100, 200, 300, 400, 500, or 1,000 nucleotides of the start codon or within about 5, 10, 15, 20, 25, 30, 35, 40, 45, 50, 100, 200, 300, 400, 500, or 1,000 nucleotides of the stop codon. For example, the guide RNA target sequence can be within a region corresponding to exon 1 of SEQ ID NO: 1 or 2 when the HSD17B13 gene is optimally aligned with SEQ ID NO: 1 or 2. Likewise, the guide RNA target sequence can be within a region corresponding to exon 7 of SEQ ID NO: 1 or 2 when the HSD17B13 gene is optimally aligned with SEQ ID NO: 1 or 2. The HSD 7B13 gene can be an HSD17B13 gene from any organism. For example, the HSD17B13 gene can be a human HSD17B13 gene or an ortholog from another organism, such as a non-human mammal, a rodent, a mouse, or a rat.

Examples of guide RNA target sequences at the 5' end of the human HSD17B13 gene comprise, consist essentially of, or consist of the sequences set forth in SEQ ID NOS: 20-81 and are set forth in the table below. Examples of guide RNA DNA-targeting segments corresponding to SEQ ID NOS: 20-81 are set forth in in the table below and are identical to SEQ ID NOS: 20-81 except with uracils instead of thymines. A guide RNA DNA-targeting segment can comprise, consist essentially of, or consist of any the DNA-targeting segment sequences set forth in the table below. Examples of guide RNA target sequences adjacent to the transcription start site (TSS) of the human HSD17B13 gene comprise, consist essentially of, or consist of the sequences set forth in SEQ ID NOS: 20-41 and are set forth in the table below. Exemplary guide RNA target sequences adjacent to the TSS include SEQ ID NOS: 21-23, 33, and 35. SEQ ID NOS: 33 and 35 are closest to the TSS. Exemplary crRNAs and sgRNAs (comprising scaffold version 1, 2, 3, or 4) corresponding to the guide RNA target sequences at the 5' end of the human HSD17B13 gene comprise, consist essentially of, or consist of any of the sequences set forth in the table below.

Guide RNA Target Sequences at 5' End of the Human HSD17B13 Gene

| Guide RNA | | | SEQ ID NO | | | | | | |
|---|---|---|---|---|---|---|---|---|---|
| | | | gRNA Target | DNA-Segment | | sgRNA | | | |
| Strand | PAM | Target Sequence | Seq | Targeting | crRNA | v1 | v2 | v3 | v4 |
| − | GGG | TGTCAGGTTAGTTAGATGAA | 42 | 1423 | 270 | 500 | 730 | 960 | 1190 |
| − | AGG | GTGTCAGGTTAGTTAGATGA | 43 | 1424 | 271 | 501 | 731 | 961 | 1191 |
| + | AGG | CCTGACACATATACAGACTA | 44 | 1425 | 272 | 502 | 732 | 962 | 1192 |
| + | GGG | CTGACACATATACAGACTAA | 45 | 1426 | 273 | 503 | 733 | 963 | 1193 |
| − | AGG | CCTTAGTCTGTATATGTGTC | 46 | 1427 | 274 | 504 | 734 | 964 | 1194 |
| + | AGG | CATATACAGACTAAGGGACC | 47 | 1428 | 275 | 505 | 735 | 965 | 1195 |
| + | GGG | ATATACAGACTAAGGGACCA | 48 | 1429 | 276 | 506 | 736 | 966 | 1196 |
| − | TGG | TCAAAGTTTGATAAATTCCC | 49 | 1430 | 277 | 507 | 737 | 967 | 1197 |
| + | TGG | AAAATACAAAGATAAGTAGA | 50 | 1431 | 278 | 508 | 738 | 968 | 1198 |
| + | TGG | ACTCTGTGACTTTAAAAAGT | 51 | 1432 | 279 | 509 | 739 | 969 | 1199 |

-continued

Guide RNA Target Sequences at 5' End of the Human HSD17B13 Gene

| Strand | PAM | Guide RNA Target Sequence | SEQ ID NO gRNA Target Seq | DNA-Segment Targeting | crRNA | sgRNA v1 | sgRNA v2 | sgRNA v3 | sgRNA v4 |
|---|---|---|---|---|---|---|---|---|---|
| − | AGG | GGTTCTGTGGGATATTAATA | 52 | 1433 | 280 | 510 | 740 | 970 | 1200 |
| − | GGG | ACAGAGCATATTGGTTCTGT | 53 | 1434 | 281 | 511 | 741 | 971 | 1201 |
| − | TGG | GACAGAGCATATTGGTTCTG | 54 | 1435 | 282 | 512 | 742 | 972 | 1202 |
| − | TGG | TGCAAAACGACAGAGCATAT | 55 | 1436 | 283 | 513 | 743 | 973 | 1203 |
| − | AGG | GAGCTGGGCATGGAATAGGC | 56 | 1437 | 284 | 514 | 744 | 974 | 1204 |
| − | AGG | ACTGGAGCTGGGCATGGAAT | 57 | 1438 | 285 | 515 | 745 | 975 | 1205 |
| − | TGG | CTCATTACTGGAGCTGGGCA | 58 | 1439 | 286 | 516 | 746 | 976 | 1206 |
| − | GGG | TTGTTCTCATTACTGGAGCT | 59 | 1440 | 287 | 517 | 747 | 977 | 1207 |
| − | TGG | ATTGTTCTCATTACTGGAGC | 60 | 1441 | 288 | 518 | 748 | 978 | 1208 |
| − | TGG | GGGGAGATTGTTCTCATTAC | 61 | 1442 | 289 | 519 | 749 | 979 | 1209 |
| − | GGG | GAGGAGAAAATCTGTGGCTG | 62 | 1443 | 290 | 520 | 750 | 980 | 1210 |
| − | GGG | AGAGGAGAAAATCTGTGGCT | 63 | 1444 | 291 | 521 | 751 | 981 | 1211 |
| − | TGG | CAGAGGAGAAAATCTGTGGC | 64 | 1445 | 292 | 522 | 752 | 982 | 1212 |
| − | TGG | TCCTCAGAGGAGAAAATCTG | 65 | 1446 | 293 | 523 | 753 | 983 | 1213 |
| − | AGG | TGAAGTTTTTCATTCCTCAG | 20 | 1447 | 294 | 524 | 754 | 984 | 1214 |
| + | AGG | CTTCACCAACGACTCCAAGT | 21 | 1448 | 295 | 525 | 755 | 985 | 1215 |
| − | TGG | CTACTCCTACTTGGAGTCGT | 22 | 1449 | 296 | 526 | 756 | 986 | 1216 |
| + | TGG | CTCCAAGTAGGAGTAGATGA | 23 | 1450 | 297 | 527 | 757 | 987 | 1217 |
| − | TGG | CACCATCATCTACTCCTACT | 24 | 1451 | 298 | 528 | 758 | 988 | 1218 |
| + | AGG | TGATGGTGATCAGAAGCAGA | 25 | 1452 | 299 | 529 | 759 | 989 | 1219 |
| + | AGG | TCAGAAGCAGAAGGATTTCT | 26 | 1453 | 300 | 530 | 760 | 990 | 1220 |
| + | TGG | GATTTCTAGGATGATGTTCA | 27 | 1454 | 301 | 531 | 761 | 991 | 1221 |
| + | TGG | TTGCTCTGTCCTCTTCCTTC | 28 | 1455 | 302 | 532 | 762 | 992 | 1222 |
| − | AGG | AGGACTGAACCAGAAGGAAG | 29 | 1456 | 303 | 533 | 763 | 993 | 1223 |
| − | AGG | TACACAAGGACTGAACCAGA | 30 | 1457 | 304 | 534 | 764 | 994 | 1224 |
| + | AGG | TTCAGTCCTTGTGTAGTCCT | 31 | 1458 | 305 | 535 | 765 | 995 | 1225 |
| + | GGG | TCAGTCCTTGTGTAGTCCTA | 32 | 1459 | 306 | 536 | 766 | 996 | 1226 |
| + | AGG | GTCCTTGTGTAGTCCTAGGG | 33 | 1460 | 307 | 537 | 767 | 997 | 1227 |
| + | AGG | CTTGTGTAGTCCTAGGGAGG | 34 | 1461 | 308 | 538 | 768 | 998 | 1228 |
| − | AGG | CTCCTCCCTAGGACTACACA | 35 | 1462 | 309 | 539 | 769 | 999 | 1229 |
| − | AGG | GTAGACAGTACCTCCTCCCT | 36 | 1463 | 310 | 540 | 770 | 1000 | 1230 |
| + | AGG | TACTGTCTACACAGAGCTCT | 37 | 1464 | 311 | 541 | 771 | 1001 | 1231 |
| + | GGG | ACTGTCTACACAGAGCTCTA | 38 | 1465 | 312 | 542 | 772 | 1002 | 1232 |
| + | AGG | TCTACACAGAGCTCTAGGGA | 39 | 1466 | 313 | 543 | 773 | 1003 | 1233 |
| + | GGG | CTACACAGAGCTCTAGGGAA | 40 | 1467 | 314 | 544 | 774 | 1004 | 1234 |

-continued

Guide RNA Target Sequences at 5' End of the Human HSD17B13 Gene

| Strand | PAM | Guide RNA Target Sequence | SEQ ID NO gRNA Target Seq | DNA-Segment Targeting | crRNA | sgRNA v1 | v2 | v3 | v4 |
|---|---|---|---|---|---|---|---|---|---|
| + | GGG | TACACAGAGCTCTAGGGAAG | 41 | 1468 | 315 | 545 | 775 | 1005 | 1235 |
| + | TGG | GGGGTGTGCCCAGTTGTTAA | 66 | 1469 | 316 | 546 | 776 | 1006 | 1236 |
| + | GGG | GGGTGTGCCCAGTTGTTAAT | 67 | 1470 | 317 | 547 | 777 | 1007 | 1237 |
| − | GGG | TGGTAGTCCCATTAACAACT | 68 | 1471 | 318 | 548 | 778 | 1008 | 1238 |
| − | TGG | CTGGTAGTCCCATTAACAAC | 69 | 1472 | 319 | 549 | 779 | 1009 | 1239 |
| + | TGG | TTGTTAATGGGACTACCAGA | 70 | 1473 | 320 | 550 | 780 | 1010 | 1240 |
| + | TGG | TACCAGATGGAAGCCAGCTT | 71 | 1474 | 321 | 551 | 781 | 1011 | 1241 |
| − | TGG | TTCCAAAGCTGGCTTCCATC | 72 | 1475 | 322 | 552 | 782 | 1012 | 1242 |
| + | AGG | TGGAAGCCAGCTTTGGAAGC | 73 | 1476 | 323 | 553 | 783 | 1013 | 1243 |
| − | TGG | ACAAGGCCTGCTTCCAAAGC | 74 | 1477 | 324 | 554 | 784 | 1014 | 1244 |
| + | TGG | GCCTTGTTCACGTGTTCTAA | 75 | 1478 | 325 | 555 | 785 | 1015 | 1245 |
| + | GGG | CCTTGTTCACGTGTTCTAAT | 76 | 1479 | 326 | 556 | 786 | 1016 | 1246 |
| − | AGG | CCCATTAGAACACGTGAACA | 77 | 1480 | 327 | 557 | 787 | 1017 | 1247 |
| − | AGG | TTGGCATCACTTCATATTTG | 78 | 1481 | 328 | 558 | 788 | 1018 | 1248 |
| − | TGG | CTTGTGCTCTTGGCATCACT | 79 | 1482 | 329 | 559 | 789 | 1019 | 1249 |
| − | TGG | AGCACACTCTCTTGTGCTCT | 80 | 1483 | 330 | 560 | 790 | 1020 | 1250 |
| + | TGG | GCACAAGAGAGTGTGCTCTC | 81 | 1484 | 331 | 561 | 791 | 1021 | 1251 |

Examples of guide RNA target sequences at the 3' end of the human HSD17B13 gene comprise, consist essentially of, or consist of the sequences set forth in SEQ ID NOS: 82-225 and are set forth in the table below. Examples of guide RNA DNA-targeting segments corresponding to SEQ ID NOS: 82-225 are set forth in SEQ ID NOS: 1485-1628, respectively, which are identical to SEQ ID NOS: 82-225 except with uracils instead of thymines. A guide RNA DNA-targeting segment can comprise, consist essentially of, or consist of any the sequences set forth in SEQ ID NOS: 1485-1628. Exemplary crRNAs and sgRNAs (comprising scaffold version 1, 2, 3, or 4) corresponding to the guide RNA target sequences at the 3' end of the human HSD17B13 gene comprise, consist essentially of, or consist of any of the sequences set forth in the table below.

Guide RNA Target Sequences at 3' End of the Human HSD17B13 Gene

| Strand | PAM | Guide RNA Target Sequence | SEQ ID NO gRNA Target Seq | crRNA | sgRNA v1 | v2 | v3 | v4 |
|---|---|---|---|---|---|---|---|---|
| + | AGG | GCTTAATCTCACACATAGAA | 82 | 332 | 562 | 792 | 1022 | 1252 |
| + | GGG | CTTAATCTCACACATAGAAA | 83 | 333 | 563 | 793 | 1023 | 1253 |
| + | GGG | TTAATCTCACACATAGAAAG | 84 | 334 | 564 | 794 | 1024 | 1254 |
| − | TGG | AGGAGTGCTGGTTTATCAAC | 85 | 335 | 565 | 795 | 1025 | 1255 |
| − | TGG | TTCTTTGACAGCAGGAGTGC | 86 | 336 | 566 | 796 | 1026 | 1256 |
| − | AGG | ACTCTGGTTTCTTTGACAGC | 87 | 337 | 567 | 797 | 1027 | 1257 |

-continued

Guide RNA Target Sequences at 3' End of the Human HSD17B13 Gene

| Strand | PAM | Guide RNA Target Sequence | SEQ ID NO gRNA Target Seq | crRNA | sgRNA v1 | sgRNA v2 | sgRNA v3 | sgRNA v4 |
|---|---|---|---|---|---|---|---|---|
| + | TGG | ACCAGAGTTGAGAAAACCCC | 88 | 338 | 568 | 798 | 1028 | 1258 |
| − | TGG | TCCAGGGGTTTTCTCAACTC | 89 | 339 | 569 | 799 | 1029 | 1259 |
| − | GGG | CAGTTATTAAATGAATCCAG | 90 | 340 | 570 | 800 | 1030 | 1260 |
| − | GGG | GCAGTTATTAAATGAATCCA | 91 | 341 | 571 | 801 | 1031 | 1261 |
| − | AGG | GGCAGTTATTAAATGAATCC | 92 | 342 | 572 | 802 | 1032 | 1262 |
| − | TGG | TGGATGGTAACAGCTACATC | 93 | 343 | 573 | 803 | 1033 | 1263 |
| + | TGG | GCTGTTACCATCCACATCCT | 94 | 344 | 574 | 804 | 1034 | 1264 |
| − | TGG | TCAAGAACCAAGGATGTGGA | 95 | 345 | 575 | 805 | 1035 | 1265 |
| − | TGG | TCCTTCAAGAACCAAGGATG | 96 | 346 | 576 | 806 | 1036 | 1266 |
| − | AGG | TGAGTGTCCTTCAAGAACCA | 97 | 347 | 577 | 807 | 1037 | 1267 |
| + | AGG | TTTTATTTTATAACTACAAG | 98 | 348 | 578 | 808 | 1038 | 1268 |
| + | AGG | TTGTTTTTAATAAAAACAAG | 99 | 349 | 579 | 809 | 1039 | 1269 |
| − | TGG | TATTATAGAATGCTTTTGCA | 100 | 350 | 580 | 810 | 1040 | 1270 |
| + | TGG | CAAGATTAGTCTTGATGTAG | 101 | 351 | 581 | 811 | 1041 | 1271 |
| + | GGG | AAGATTAGTCTTGATGTAGT | 102 | 352 | 582 | 812 | 1042 | 1272 |
| + | CGG | AGTCTTGATGTAGTGGGAGT | 103 | 353 | 583 | 813 | 1043 | 1273 |
| + | AGG | TTTTTCTATTAAAAAAAAAA | 104 | 354 | 584 | 814 | 1044 | 1274 |
| + | TGG | TCTATTAAAAAAAAAAAGGC | 105 | 355 | 585 | 815 | 1045 | 1275 |
| + | GGG | CTATTAAAAAAAAAAAGGCT | 106 | 356 | 586 | 816 | 1046 | 1276 |
| + | CGG | AAAAAAAAAAAGGCTGGGCA | 107 | 357 | 587 | 817 | 1047 | 1277 |
| + | TGG | AAAAAAAAGGCTGGGCACGG | 108 | 358 | 588 | 818 | 1048 | 1278 |
| + | TGG | CACCCGTAATCCCAGCACTT | 109 | 359 | 589 | 819 | 1049 | 1279 |
| + | GGG | ACCCGTAATCCCAGCACTTT | 110 | 360 | 590 | 820 | 1050 | 1280 |
| + | AGG | CGTAATCCCAGCACTTTGGG | 111 | 361 | 591 | 821 | 1051 | 1281 |
| − | GGG | TCCCAAAGTGCTGGGATTAC | 112 | 362 | 592 | 822 | 1052 | 1282 |
| − | CGG | CTCCCAAAGTGCTGGGATTA | 113 | 363 | 593 | 823 | 1053 | 1283 |
| + | AGG | CCCAGCACTTTGGGAGGCCG | 114 | 364 | 594 | 824 | 1054 | 1284 |
| − | GGG | CCTCGGCCTCCCAAAGTGCT | 115 | 365 | 595 | 825 | 1055 | 1285 |
| + | AGG | GCACTTTGGGAGGCCGAGGC | 116 | 366 | 596 | 826 | 1056 | 1286 |
| + | TGG | CTTTGGGAGGCCGAGGCAGG | 117 | 367 | 597 | 827 | 1057 | 1287 |
| + | AGG | GCCGAGGCAGGTGGATCACG | 118 | 368 | 598 | 828 | 1058 | 1288 |
| − | CGG | ACCTCGTGATCCACCTGCCT | 119 | 369 | 599 | 829 | 1059 | 1289 |
| + | AGG | GGCAGGTGGATCACGAGGTC | 120 | 370 | 600 | 830 | 1060 | 1290 |
| + | TGG | TCAGGAGATCGAGACCATCT | 121 | 371 | 601 | 831 | 1061 | 1291 |
| + | TGG | CGAGACCATCTTGGCTAACA | 122 | 372 | 602 | 832 | 1062 | 1292 |

-continued

Guide RNA Target Sequences at 3' End of the Human HSD17B13 Gene

| Strand | PAM | Guide RNA Target Sequence | SEQ ID NO gRNA Target Seq | crRNA | sgRNA v1 | v2 | v3 | v4 |
|---|---|---|---|---|---|---|---|---|
| − | TGG | TTTCACCATGTTAGCCAAGA | 123 | 373 | 603 | 833 | 1063 | 1293 |
| − | GGG | TTGTATTTTTTGTAGAGACG | 124 | 374 | 604 | 834 | 1064 | 1294 |
| − | GGG | TTTGTATTTTTTGTAGAGAC | 125 | 375 | 605 | 835 | 1065 | 1295 |
| − | CGG | TTTTGTATTTTTTGTAGAGA | 126 | 376 | 606 | 836 | 1066 | 1296 |
| + | CGG | AAAAAATACAAAAAATTAGC | 127 | 377 | 607 | 837 | 1067 | 1297 |
| + | GGG | AAAAATACAAAAAATTAGCC | 128 | 378 | 608 | 838 | 1068 | 1298 |
| + | TGG | TACAAAAAATTAGCCGGGTG | 129 | 379 | 609 | 839 | 1069 | 1299 |
| + | TGG | AAAAAATTAGCCGGGTGTGG | 130 | 380 | 610 | 840 | 1070 | 1300 |
| + | CGG | AAATTAGCCGGGTGTGGTGG | 131 | 381 | 611 | 841 | 1071 | 1301 |
| + | GGG | AATTAGCCGGGTGTGGTGGC | 132 | 382 | 612 | 842 | 1072 | 1302 |
| − | CGG | CAGGCGCCCGCCACCACACC | 133 | 383 | 613 | 843 | 1073 | 1303 |
| + | AGG | GCCTGTAGTCCCAGCTACTC | 134 | 384 | 614 | 844 | 1074 | 1304 |
| + | AGG | TGTAGTCCCAGCTACTCAGG | 135 | 385 | 615 | 845 | 1075 | 1305 |
| − | AGG | TCCTGAGTAGCTGGGACTAC | 136 | 386 | 616 | 846 | 1076 | 1306 |
| + | AGG | CCCAGCTACTCAGGAGGCTG | 137 | 387 | 617 | 847 | 1077 | 1307 |
| − | GGG | CCTCAGCCTCCTGAGTAGCT | 138 | 388 | 618 | 848 | 1078 | 1308 |
| − | TGG | GCCTCAGCCTCCTGAGTAGC | 139 | 389 | 619 | 849 | 1079 | 1309 |
| + | TGG | AGGAGGCTGAGGCAGGAGAA | 140 | 390 | 620 | 850 | 1080 | 1310 |
| + | CGG | GCAGGAGAATGGCGTGAACC | 141 | 391 | 621 | 851 | 1081 | 1311 |
| + | GGG | CAGGAGAATGGCGTGAACCC | 142 | 392 | 622 | 852 | 1082 | 1312 |
| + | AGG | GAGAATGGCGTGAACCCGGG | 143 | 393 | 623 | 853 | 1083 | 1313 |
| + | TGG | AATGGCGTGAACCCGGGAGG | 144 | 394 | 624 | 854 | 1084 | 1314 |
| − | GGG | CACTGCAAGCTCCACCTCCC | 145 | 395 | 625 | 855 | 1085 | 1315 |
| − | CGG | TCACTGCAAGCTCCACCTCC | 146 | 396 | 626 | 856 | 1086 | 1316 |
| + | TGG | CATACCACTGCACTCCAGCC | 147 | 397 | 627 | 857 | 1087 | 1317 |
| + | GGG | ATACCACTGCACTCCAGCCT | 148 | 398 | 628 | 858 | 1088 | 1318 |
| − | TGG | TCGCCCAGGCTGGAGTGCAG | 149 | 399 | 629 | 859 | 1089 | 1319 |
| − | TGG | TCTCACTCTTTCGCCCAGGC | 150 | 400 | 630 | 860 | 1090 | 1320 |
| − | AGG | GGAGTCTCACTCTTTCGCCC | 151 | 401 | 631 | 861 | 1091 | 1321 |
| − | TGG | TGTTTTTTGTTTTTTTGAGA | 152 | 402 | 632 | 862 | 1092 | 1322 |
| − | TGG | AGGAAGAAAGAAAGGTTTTT | 153 | 403 | 633 | 863 | 1093 | 1323 |
| − | AGG | AGAAGAAAAGGAAGAAAGAA | 154 | 404 | 634 | 864 | 1094 | 1324 |
| + | TGG | CTTTCTTCCTTTTCTTCTCT | 155 | 405 | 635 | 865 | 1095 | 1325 |
| + | GGG | TTTCTTCCTTTTCTTCTCTT | 156 | 406 | 636 | 866 | 1096 | 1326 |
| − | AGG | AATGGACCCAAGAGAAGAAA | 157 | 407 | 637 | 867 | 1097 | 1327 |

-continued

Guide RNA Target Sequences at 3' End of the Human HSD17B13 Gene

| | | | SEQ ID NO | | | | | |
|---|---|---|---|---|---|---|---|---|
| | | Guide RNA | gRNA | | sgRNA | | | |
| Strand | PAM | Target Sequence | Target | Seq crRNA | v1 | v2 | v3 | v4 |
| − | TGG | GGCTATTACATAAGAAACAA | 158 | 408 | 638 | 868 | 1098 | 1328 |
| − | TGG | CACAGGAAAAGGAACTGTAC | 159 | 409 | 639 | 869 | 1099 | 1329 |
| − | AGG | ATTAAAGCTAACACAGGAAA | 160 | 410 | 640 | 870 | 1100 | 1330 |
| − | AGG | TCAAAAATTAAAGCTAACAC | 161 | 411 | 641 | 871 | 1101 | 1331 |
| + | TGG | TAAAATTGTCTAAACATCTC | 162 | 412 | 642 | 872 | 1102 | 1332 |
| − | AGG | AGAGATGTTTAGACAATTTT | 163 | 413 | 643 | 873 | 1103 | 1333 |
| + | AGG | TCTAAACATCTCTGGGACCA | 164 | 414 | 644 | 874 | 1104 | 1334 |
| − | TGG | TTTATGCTTTCATATATCCT | 165 | 415 | 645 | 875 | 1105 | 1335 |
| + | AGG | AGCATAAATTACAAAGAAAA | 166 | 416 | 646 | 876 | 1106 | 1336 |
| + | TGG | TACAAAGAAAAAGGTTATCA | 167 | 417 | 647 | 877 | 1107 | 1337 |
| + | GGG | ACAAAGAAAAAGGTTATCAT | 168 | 418 | 648 | 878 | 1108 | 1338 |
| + | GGG | CAAAGAAAAAGGTTATCATG | 169 | 419 | 649 | 879 | 1109 | 1339 |
| + | CGG | TCTGAGATTTAAAATAGAGT | 170 | 420 | 650 | 880 | 1110 | 1340 |
| − | AGG | CTTATAAGATACATTATGAA | 171 | 421 | 651 | 881 | 1111 | 1341 |
| + | AGG | TATCTTATAAGACTATAAAA | 172 | 422 | 652 | 882 | 1112 | 1342 |
| + | GGG | ATCTTATAAGACTATAAAAA | 173 | 423 | 653 | 883 | 1113 | 1343 |
| + | AGG | TTATAAGACTATAAAAAGGG | 174 | 424 | 654 | 884 | 1114 | 1344 |
| + | AGG | TAAAAAGGGAGGAAATATAG | 175 | 425 | 655 | 885 | 1115 | 1345 |
| + | GGG | AAAAAGGGAGGAAATATAGA | 176 | 426 | 656 | 886 | 1116 | 1346 |
| + | TGG | AAATATAGAGGGTCCACTTT | 177 | 427 | 657 | 887 | 1117 | 1347 |
| + | TGG | TATAGAGGGTCCACTTTTGG | 178 | 428 | 658 | 888 | 1118 | 1348 |
| − | TGG | ACTCTGAAGTCCACCAAAAG | 179 | 429 | 659 | 889 | 1119 | 1349 |
| + | TGG | AGAATAGAGTTGCACCGTTT | 180 | 430 | 660 | 890 | 1120 | 1350 |
| − | TGG | AAAACGGTGCAACTCTATTC | 181 | 431 | 661 | 891 | 1121 | 1351 |
| + | AGG | CCGTTTTGGGCTAATGAAAA | 182 | 432 | 662 | 892 | 1122 | 1352 |
| − | CGG | CCTTTTTCATTAGCCCAAAA | 183 | 433 | 663 | 893 | 1123 | 1353 |
| + | AGG | TGGGCTAATGAAAAAGGAAG | 184 | 434 | 664 | 894 | 1124 | 1354 |
| + | AGG | TAATGAAAAAGGAAGAGGCT | 185 | 435 | 665 | 895 | 1125 | 1355 |
| + | GGG | AATGAAAAAGGAAGAGGCTA | 186 | 436 | 666 | 896 | 1126 | 1356 |
| + | AGG | CTGAATCTTAAAATATGTCC | 187 | 437 | 667 | 897 | 1127 | 1357 |
| − | TGG | CAGGCAGCTTTATCTCAACC | 188 | 438 | 668 | 898 | 1128 | 1358 |
| − | AGG | CTAAGAGATCAAGTTTCAGC | 189 | 439 | 669 | 899 | 1129 | 1359 |
| + | TGG | GTGTTCTTGTTGATATTCTG | 190 | 440 | 670 | 900 | 1130 | 1360 |
| + | TGG | CTTGTTGATATTCTGTGGCA | 191 | 441 | 671 | 901 | 1131 | 1361 |
| + | TGG | TCTGTGGCATGGCTACAGAT | 192 | 442 | 672 | 902 | 1132 | 1362 |

-continued

Guide RNA Target Sequences at 3' End of the Human HSD17B13 Gene

| | | Guide RNA | SEQ ID NO gRNA | | SEQ ID NO sgRNA | | | |
|---|---|---|---|---|---|---|---|---|
| Strand | PAM | Target Sequence | Target Seq | crRNA | v1 | v2 | v3 | v4 |
| − | AGG | AGAACTTATTTACACAGGGA | 193 | 443 | 673 | 903 | 1133 | 1363 |
| − | GGG | AAAGAGAACTTATTTACACA | 194 | 444 | 674 | 904 | 1134 | 1364 |
| − | AGG | CAAAGAGAACTTATTTACAC | 195 | 445 | 675 | 905 | 1135 | 1365 |
| + | AGG | TTCTCTTTGTATTTACTTTT | 196 | 446 | 676 | 906 | 1136 | 1366 |
| + | GGG | TCTCTTTGTATTTACTTTTA | 197 | 447 | 677 | 907 | 1137 | 1367 |
| + | AGG | CTTTGTATTTACTTTTAGGG | 198 | 448 | 678 | 908 | 1138 | 1368 |
| + | TGG | AGCTTTTGTCCACCTTTAAA | 199 | 449 | 679 | 909 | 1139 | 1369 |
| − | TGG | TTTATTTTTCCATTTAAAGG | 200 | 450 | 680 | 910 | 1140 | 1370 |
| − | AGG | TATTTTATTTTTCCATTTAA | 201 | 451 | 681 | 911 | 1141 | 1371 |
| − | AGG | CTTACATAAACATACTTAAA | 202 | 452 | 682 | 912 | 1142 | 1372 |
| + | AGG | TAAGCACAGAAGTTTTTAAG | 203 | 453 | 683 | 913 | 1143 | 1373 |
| + | AGG | AAGTTTTTAAGAGGCATGAA | 204 | 454 | 684 | 914 | 1144 | 1374 |
| − | AGG | ATATTTACGTAGTTTTTCAT | 205 | 455 | 685 | 915 | 1145 | 1375 |
| + | AGG | CGTAAATATTCTTGAGAAAC | 206 | 456 | 686 | 916 | 1146 | 1376 |
| + | AGG | TTCTTGAGAAACAGGAAGAC | 207 | 457 | 687 | 917 | 1147 | 1377 |
| − | TGG | TAATATTAAAAACATTGGTT | 208 | 458 | 688 | 918 | 1148 | 1378 |
| + | AGG | CCAATGTTTTTAATATTATC | 209 | 459 | 689 | 919 | 1149 | 1379 |
| − | TGG | CCTGATAATATTAAAAACAT | 210 | 460 | 690 | 920 | 1150 | 1380 |
| + | TGG | CATTATCATGCATACATCTC | 211 | 461 | 691 | 921 | 1151 | 1381 |
| + | TGG | ATCATGCATACATCTCTGGC | 212 | 462 | 692 | 922 | 1152 | 1382 |
| + | TGG | TTCATTTCATTTTGATTTTG | 213 | 463 | 693 | 923 | 1153 | 1383 |
| − | TGG | ATTCAATTTGAAGCAGTGGT | 214 | 464 | 694 | 924 | 1154 | 1384 |
| − | TGG | GAATATTCAATTTGAAGCAG | 215 | 465 | 695 | 925 | 1155 | 1385 |
| + | AGG | CATACGATTTAAAATCGCTG | 216 | 466 | 696 | 926 | 1156 | 1386 |
| + | AGG | AAAATCGCTGAGGCGCGTTC | 217 | 467 | 697 | 927 | 1157 | 1387 |
| − | AGG | TTTTTTTTTCTTTTTTGTAC | 218 | 468 | 698 | 928 | 1158 | 1388 |
| − | TGG | CTGTTGTCAAAGATTTTAAA | 219 | 469 | 699 | 929 | 1159 | 1389 |
| + | TGG | TGACAACAGAGTTCTGTTTT | 220 | 470 | 700 | 930 | 1160 | 1390 |
| + | TGG | AGAATACGCTGAGAGTTATC | 221 | 471 | 701 | 931 | 1161 | 1391 |
| − | AGG | GCAAGAGAAGAAAAGAACGG | 222 | 472 | 702 | 932 | 1162 | 1392 |
| − | CGG | GTTGCAAGAGAAGAAAAGAA | 223 | 473 | 703 | 933 | 1163 | 1393 |
| − | TGG | ATGCACACGTAAAAGAGAGG | 224 | 474 | 704 | 934 | 1164 | 1394 |
| − | AGG | AAGATGCACACGTAAAAGAG | 225 | 475 | 705 | 935 | 1165 | 1395 |

Examples of guide RNA target sequences proximate to a position corresponding to position 12666 of SEQ ID NO: 2 comprise, consist essentially of, or consist of the sequences set forth in SEQ ID NOS: 226-239 and are set forth in the table below. Examples of guide RNA DNA-targeting segments corresponding to SEQ ID NOS: 226-239 are set forth in SEQ ID NOS: 1629-1642, respectively, which are identical to SEQ ID NOS: 226-239 except with uracils instead of thymines. A guide RNA DNA-targeting segment can comprise, consist essentially of, or consist of any the sequences set forth in SEQ ID NOS: 1629-1642. Exemplary guide RNA target sequences proximate to a position corresponding to position 12666 of SEQ ID NO: 2 include SEQ ID NOS: 230 and 231. Exemplary crRNAs and sgRNAs (comprising scaffold version 1, 2, 3, or 4) corresponding to the guide RNA target sequences proximate to a position corresponding to position 12666 of SEQ ID NO: 2 comprise, consist essentially of, or consist of any of the sequences set forth in the table below.

Guide RNA Target Sequences Near rs72613567 Variation

| Strand | PAM | Guide RNA Target Sequence | Distance to Variation (bp) | SEQ ID NO gRNA Seq Target | crRNA | sgRNA v1 | v2 | v3 | v4 |
|---|---|---|---|---|---|---|---|---|---|
| + | TGG | ATCATGCATACATCTCTGGC | 107 | 226 | 476 | 706 | 936 | 1166 | 1396 |
| + | TGG | TTCATTTCATTTTGATTTTG | 74 | 227 | 477 | 707 | 937 | 1167 | 1397 |
| - | TGG | ATTCAATTTGAAGCAGTGGT | 62 | 228 | 478 | 708 | 938 | 1168 | 1398 |
| - | TGG | GAATATTCAATTTGAAGCAG | 58 | 229 | 479 | 709 | 939 | 1169 | 1399 |
| + | AGG | CATACGATTTAAAATCGCTG | 22 | 230 | 480 | 710 | 940 | 1170 | 1400 |
| + | AGG | AAAATCGCTGAGGCGCGTTC | 12 | 231 | 481 | 711 | 941 | 1171 | 1401 |
| - | AGG | TTTTTTTTTCTTTTTTGTAC | 22 | 232 | 482 | 712 | 942 | 1172 | 1402 |
| - | TGG | CTGTTGTCAAAGATTTTAAA | 40 | 233 | 483 | 713 | 943 | 1173 | 1403 |
| + | TGG | TGACAACAGAGTTCTGTTTT | 65 | 234 | 484 | 714 | 944 | 1174 | 1404 |
| + | TGG | AGAATACGCTGAGAGTTATC | 94 | 235 | 485 | 715 | 945 | 1175 | 1405 |
| - | AGG | GCAAGAGAAGAAAAGAACGG | 121 | 236 | 486 | 716 | 946 | 1176 | 1406 |
| - | CGG | GTTGCAAGAGAAGAAAAGAA | 124 | 237 | 487 | 717 | 947 | 1177 | 1407 |
| - | TGG | ATGCACACGTAAAAGAGAGG | 146 | 238 | 488 | 718 | 948 | 1178 | 1408 |
| - | AGG | AAGATGCACACGTAAAAGAG | 149 | 239 | 489 | 719 | 949 | 1179 | 1409 |

Examples of guide RNA target sequences in the mouse Hsd17b13 gene proximate to a position corresponding to position 12666 of SEQ ID NO: 2 when the mouse Hsd117b13 gene is optimally aligned with SEQ ID NO: 2 comprise, consist essentially of, or consist of the sequences set forth in Table 12 in Example 4. Examples of guide RNA target sequences at the 5' end of the mouse Hsd17b13 gene comprise, consist essentially of, or consist of the sequences set forth Table 12 in Example 4. Examples of guide RNA DNA-targeting segments corresponding to those guide RNA target sequences are also set forth in Table 12 in Example 4. A guide RNA DNA-targeting segment can comprise, consist essentially of, or consist of any those sequences. Exemplary crRNAs and sgRNAs (comprising scaffold version 1, 2, 3, or 4) corresponding to the guide RNA target sequences in Table 12 in Example 4 can comprise, consist essentially of, or consist of any of the crRNA or sgRNA sequences set forth in Table 12 in Example 4.

Guide RNAs can comprise two segments: a "DNA-targeting segment" and a "protein-binding segment." "Segment" includes a section or region of a molecule, such as a contiguous stretch of nucleotides in an RNA. Some gRNAs, such as those for Cas9, can comprise two separate RNA molecules: an "activator-RNA" (e.g., tracrRNA) and a "targeter-RNA" (e.g., CRISPR RNA or crRNA). Other gRNAs area single RNA molecule (single RNA polynucleotide), which can also be called a "single-molecule gRNA," a "single-guide RNA," or an "sgRNA." See, e.g., WO 2013/176772, WO 2014/065596, WO 2014/089290, WO 2014/093622, WO 2014/099750, WO 2013/142578, and WO 2014/131833, each of which is herein incorporated by reference in its entirety for all purposes. For Cas9, for example, a single-guide RNA can comprise a crRNA fused to a tracrRNA (e.g., via a linker). For Cpf1, for example, only a crRNA is needed to achieve binding to and/or cleavage of a target sequence. The terms "guide RNA" and "gRNA" include both double-molecule (i.e., modular) gRNAs and single-molecule gRNAs.

An exemplary two-molecule gRNA comprises a crRNA-like ("CRISPR RNA" or "targeter-RNA" or "crRNA" or "crRNA repeat") molecule and a corresponding tracrRNA-like ("trans-acting CRISPR RNA" or "activator-RNA" or "tracrRNA") molecule. A crRNA comprises both the DNA-targeting segment (single-stranded) of the gRNA and a stretch of nucleotides (i.e., the crRNA tail) that forms one half of the dsRNA duplex of the protein-binding segment of the gRNA. An example of a crRNA tail, located downstream (3') of the DNA-targeting segment, comprises, consists essentially of, or consists of GUUUUAGAGCUAUGCU (SEQ ID NO: 1421). Any of the DNA-targeting segments disclosed herein can be joined to the 5' end of SEQ CD NO: 1421 to form a crRNA.

A corresponding tracrRNA (activator-RNA) comprises a stretch of nucleotides that forms the other half of the dsRNA duplex of the protein-binding segment of the gRNA. A stretch of nucleotides of a crRNA are complementary to and hybridize with a stretch of nucleotides of a tracrRNA to form the dsRNA duplex of the protein-binding domain of the gRNA. As such, each crRNA can be said to have a corresponding tracrRNA. An example of a tracrRNA sequence comprises, consists essentially of, or consists of (SEQ ID NO: 1422)
AGCAUAGCAAGUUAAAAUAAGGCUAGUCCGUUAUCAACUUGAAAAAGUGG

CACCGAGUCGGUGCUUU.

In systems in which both a crRNA and a tracrRNA are needed, the crRNA and the corresponding tracrRNA hybridize to form a gRNA. In systems in which only a crRNA is needed, the crRNA can be the gRNA. The crRNA additionally provides the single-stranded DNA-targeting segment that targets a guide RNA target sequence by hybridizing to the opposite strand (i.e., the complementary strand). If used for modification within a cell, the exact sequence of a given crRNA or tracrRNA molecule can be designed to be specific to the species in which the RNA molecules will be used. See, e.g., Mali et al. (2013) *Science* 339:823-826; Jinek et al. (2012). *Science* 337:816-821; Hwang et al. (2013) *Nat. Biotechnol.* 31:227-229; Jiang et al. (2013) *Nat. Biotechnol.* 31:233-239; and Cong et al. (2013) *Science* 339:819-823, each of which is herein incorporated by reference in its entirety for all purposes.

The DNA-targeting segment (crRNA) of a given gRNA comprises a nucleotide sequence that is complementary to a sequence (i.e., the complementary strand of the guide RNA recognition sequence on the strand opposite of the guide RNA target sequence) in a target DNA. The DNA-targeting segment of a gRNA interacts with a target DNA (e.g., the HSD17B13 gene) in a sequence-specific manner via hybridization (i.e., base pairing). As such, the nucleotide sequence of the DNA-targeting segment may vary and determines the location within the target DNA with which the gRNA and the target DNA will interact. The DNA-targeting segment of a subject gRNA can be modified to hybridize to any desired sequence within a target DNA. Naturally occurring crRNAs differ depending on the CRISPR/Cas system and organism but often contain a targeting segment of between 21 to 72 nucleotides length, flanked by two direct repeats (DR) of a length of between 21 to 46 nucleotides (see, e.g., WO 2014/131833, herein incorporated by reference in its entirety for all purposes). In the case of *S. pyogenes*, the DRs are 36 nucleotides long and the targeting segment is 30 nucleotides long. The 3' located DR is complementary to and hybridizes with the corresponding tracrRNA, which in turn binds to the Cas protein.

The DNA-targeting segment can have a length of at least about 12 nucleotides, at least about 15 nucleotides, at least about 17 nucleotides, at least about 18 nucleotides, at least about 19 nucleotides, at least about 20 nucleotides, at least about 25 nucleotides, at least about 30 nucleotides, at least about 35 nucleotides, or at least about 40 nucleotides. Such DNA-targeting segments can have a length from about 12 nucleotides to about 100 nucleotides, from about 12 nucleotides to about 80 nucleotides, from about 12 nucleotides to about 50 nucleotides, from about 12 nucleotides to about 40 nucleotides, from about 12 nucleotides to about 30 nucleotides, from about 12 nucleotides to about 25 nucleotides, or from about 12 nucleotides to about 20 nucleotides. For example, the DNA targeting segment can be from about 15 nucleotides to about 25 nucleotides (e.g., from about 17 nucleotides to about 20 nucleotides, or about 17 nucleotides, about 18 nucleotides, about 19 nucleotides, or about 20 nucleotides). See, e.g., US 2016/0024523, herein incorporated by reference in its entirety for all purposes. For Cas9 from *S. pyogenes*, a typical DNA-targeting segment is between 16 and 20 nucleotides in length or between 17 and 20 nucleotides in length. For Cas9 from *S. aureus*, a typical DNA-targeting segment is between 21 and 23 nucleotides in length. For Cpf1, a typical DNA-targeting segment is at least 16 nucleotides in length or at least 18 nucleotides in length.

TracrRNAs can be in any form (e.g., full-length tracrRNAs or active partial tracrRNAs) and of varying lengths. They can include primary transcripts or processed forms. For example, tracrRNAs (as part of a single-guide RNA or as a separate molecule as part of a two-molecule gRNA) may comprise or consist of all or a portion of a wild type tracrRNA sequence (e.g., about or more than about 20, 26, 32, 45, 48, 54, 63, 67, 85, or more nucleotides of a wild type tracrRNA sequence). Examples of wild type tracrRNA sequences from *S. pyogenes* include 171-nucleotide, 89-nucleotide, 75-nucleotide, and 65-nucleotide versions. See, e.g., Deltcheva et al. (2011) Nature 471:602-607; WO 2014/093661, each of which is herein incorporated by reference in its entirety for all purposes. Examples of tracrRNAs within single-guide RNAs (sgRNAs) include the tracrRNA segments found within +48, +54, +67, and +85 versions of sgRNAs, where "+n" indicates that up to the +n nucleotide of wild type tracrRNA is included in the sgRNA. See U.S. Pat. No. 8,697,359, herein incorporated by reference in its entirety for all purposes.

The percent complementarity between the DNA-targeting sequence and the complementary strand of the guide RNA recognition sequence within the target DNA can be at least 60% (e.g., at least 65%, at least 70%, at least 75%, at least 80%, at least 85%, at least 90%, at least 95%, at least 97%, at least 98%, at least 99%, or 100%). The percent complementarity between the DNA-targeting sequence and the complementary strand of the guide RNA recognition sequence within the target DNA can be at least 60% over about 20 contiguous nucleotides. As an example, the percent complementarity between the DNA-targeting sequence and the complementary strand of the guide RNA recognition sequence within the target DNA is 100% over the 14 contiguous nucleotides at the 5' end of the complementary strand of the guide RNA recognition sequence within the complementary strand of the target DNA and as low as 0% over the remainder. In such a case, the DNA-targeting sequence can be considered to be 14 nucleotides in length. As another example, the percent complementarity between the DNA-targeting sequence and the complementary strand of the guide RNA recognition sequence within the target DNA is 100% over the seven contiguous nucleotides at the 5' end of the complementary strand of the guide RNA recognition sequence within the complementary strand of the target DNA and as low as 0% over the remainder. In such a case, the DNA-targeting sequence can be considered to be 7 nucleotides in length. In some guide RNAs, at least 17 nucleotides within the DNA-targeting sequence are complementary to the target DNA. For example, the DNA-targeting sequence can be 20 nucleotides in length and can comprise 1, 2, or 3 mismatches with the complementary strand of the guide RNA recognition sequence. Preferably, the mismatches are not adjacent to a protospacer adjacent motif (PAM) sequence (e.g., the mismatches are in the 5' end of the DNA-targeting sequence, or the mismatches are at least 2, 3, 4, 5, 6, 7, 8, 9, 10, 11, 12, 13, 14, 15, 16, 17, 18, or 19 base pairs away from the PAM sequence).

The protein-binding segment of a gRNA can comprise two stretches of nucleotides that are complementary to one another. The complementary nucleotides of the protein-binding segment hybridize to form a double-stranded RNA duplex (dsRNA). The protein-binding segment of a subject gRNA interacts with a Cas protein, and the gRNA directs the bound Cas protein to a specific nucleotide sequence within target DNA via the DNA-targeting segment.

Single-guide RNAs have the DNA-targeting segment and a scaffold sequence (i.e., the protein-binding or Cas-binding sequence of the guide RNA). For example, such guide RNAs have a 5' DNA-targeting segment and a 3' scaffold sequence. Exemplary scaffold sequences comprise, consist essentially of, or consist of: GUUUUAGAGCUA-GAAAUAGCAAGUUAAAAUAAGGCUAGU-CCGUUAUCAACUUGA AAAAGUGGCACCGAGUCG-GUGCU (version 1; SEQ ID NO: 1420); GUUGGAACCAUUCAAAACAG-CAUAGCAAGUUAAAAUAAGGCUAGU-CCGUUAUCA ACUUGAAAAAGUGGCACCGAGUCG-GUGC (version 2; SEQ ID NO: 256); GUUUUAGAGCUA-GAAAUAGCAAGUUAAAAUAAGGCUAGU-CCGUUAUCAACUUGA AAAAGUGGCACCGAGUCG-GUGC (version 3; SEQ ID NO: 257); and GUUUAAGAGCUAUGCUGGAAACAG-CAUAGCAAGUUUAAAUAAGGCUAGUCCGUU AUCAACUUGAAAAAGUGGCACCGAGUCGGUGC (version 4; SEQ ID NO: 258). Guide RNAs targeting any of the guide RNA target sequences disclosed herein (e.g., SEQ ID NOS: 20 239 and 259-268) can include, for example, a DNA-targeting segment on the 5' end of the guide RNA fused to any of the exemplary guide RNA scaffold sequences on the 3' end of the guide RNA. That is, any of the DNA-targeting segments disclosed herein can be joined to the 5' end of any one of SEQ ID NOS: 1420, 256, 257, or 258 to form a single guide RNA (chimeric guide RNA). Guide RNA versions 1, 2, 3, and 4 as disclosed elsewhere herein refer to DNA-targeting segments joined with scaffold versions 1, 2, 3, and 4, respectively.

Guide RNAs can include modifications or sequences that provide for additional desirable features (e.g., modified or regulated stability; subcellular targeting; tracking with a fluorescent label; a binding site for a protein or protein complex; and the like). Examples of such modifications include, for example, a 5' cap (e.g., a 7-methylguanylate cap (m7G)); a 3' polyadenylated tail (i.e., a 3' poly(A) tail); a riboswitch sequence (e.g., to allow for regulated stability and/or regulated accessibility by proteins and/or protein complexes); a stability control sequence; a sequence that forms a dsRNA duplex (i.e., a hairpin); a modification or sequence that targets the RNA to a subcellular location (e.g., nucleus, mitochondria, chloroplasts, and the like); a modification or sequence that provides for tracking (e.g., direct conjugation to a fluorescent molecule, conjugation to a moiety that facilitates fluorescent detection, a sequence that allows for fluorescent detection, and so forth); a modification or sequence that provides a binding site for proteins (e.g., proteins that act on DNA, including transcriptional activators, transcriptional repressors, DNA methyltransferases, DNA demethylases, histone acetyltransferases, histone deacetylases, and the like); and combinations thereof. Other examples of modifications include engineered stem loop duplex structures, engineered bulge regions, engineered hairpins 3' of the stem loop duplex structure, or any combination thereof. See, e.g., US 2015/0376586, herein incorporated by reference in its entirety for all purposes. A bulge can be an unpaired region of nucleotides within the duplex made up of the crRNA-like region and the minimum tracrRNA-like region. A bulge can comprise, on one side of the duplex, an unpaired 5'-XXXY-3' where X is any purine and Y can be a nucleotide that can form a wobble pair with a nucleotide on the opposite strand, and an unpaired nucleotide region on the other side of the duplex.

In some cases, a transcriptional activation system can be used comprising a dCas9-VP64 fusion protein paired with MS2-p65-HSF 1. Guide RNAs in such systems can be designed with aptamer sequences appended to sgRNA tetraloop and stem-loop 2 designed to bind dimerized MS2 bacteriophage coat proteins. See, e.g., Konermann et al. (2015) Nature 517(7536):583-588, herein incorporated by reference in its entirety for all purposes.

Guide RNAs can be provided in any form. For example, the gRNA can be provided in the form of RNA, either as two molecules (separate crRNA and tracrRNA) or as one molecule (sgRNA), and optionally in the form of a complex with a Cas protein. For example, gRNAs can be prepared by in vitro transcription using, for example, T7 RNA polymerase (see, e.g., WO 2014/089290 and WO 2014/065596, each of which is herein incorporated by reference in its entirety for all purposes). Guide RNAs can also be prepared by chemical synthesis.

The gRNA can also be provided in the form of DNA encoding the gRNA. The DNA encoding the gRNA can encode a single RNA molecule (sgRNA) or separate RNA molecules (e.g., separate crRNA and tracrRNA). In the latter case, the DNA encoding the gRNA can be provided as one DNA molecule or as separate DNA molecules encoding the crRNA and tracrRNA, respectively.

When a gRNA is provided in the form of DNA, the gRNA can be transiently, conditionally, or constitutively expressed in the cell. DNAs encoding gRNAs can be stably integrated into the genome of the cell and operably linked to a promoter active in the cell. Alternatively, DNAs encoding gRNAs can be operably linked to a promoter in an expression construct. For example, the DNA encoding the gRNA can be in a vector comprising a heterologous nucleic acid. The vector can further comprise an exogenous donor sequence and/or the vector can further comprise a nucleic acid encoding a Cas protein. Alternatively, the DNA encoding the gRNA can be in a vector or a plasmid that is separate from the vector comprising an exogenous donor sequence and/or the vector comprising the nucleic acid encoding the Cas protein. Promoters that can be used in such expression constructs include promoters active, for example, in one or more of a eukaryotic cell, a human cell, a non-human cell, a mammalian cell, a non-human mammalian cell, a rodent cell, a mouse cell, a rat cell, a hamster cell, a rabbit cell, a pluripotent cell, an embryonic stem (ES) cell, an adult stem cell, a developmentally restricted progenitor cell, an induced pluripotent stem (iPS) cell, or a one-cell stage embryo. Such promoters can be, for example, conditional promoters, inducible promoters, constitutive promoters, or tissue-specific promoters. Such promoters can also be, for example, bidirectional promoters. Specific examples of suitable promoters include an RNA polymerase III promoter, such as a human U6 promoter, a rat U6 polymerase III promoter, or a mouse U6 polymerase III promoter.

Also disclosed herein are compositions comprising one or more guide RNAs (e.g., 1, 2, 3, 4, or more guide RNAs) disclosed herein and a carrier increasing the stability of the isolated nucleic acid or protein (e.g., prolonging the period under given conditions of storage (e.g., −20 °C, 4 °C, or ambient temperature) for which degradation products remain below a threshold, such below 0.5% by weight of the starting nucleic acid or protein; or increasing the stability in vivo). Non-limiting examples of such carriers include poly (lactic acid) (PLA) microspheres, poly(D,L-lactic-coglycolic-acid) (PLGA) microspheres, liposomes, micelles, inverse micelles, lipid cochleates, and lipid microtubules. Such compositions can further comprise a Cas protein, such as a Cas9 protein, or a nucleic acid encoding a Cas protein. Such compositions can further comprise one or more (e.g., 1, 2, 3, 4, or more) exogenous donor sequences and/or one or more (e.g., 1, 2, 3, 4, or more) targeting vectors and/or one or more (e.g., 1, 2, 3, 4, or more) expression vectors as disclosed elsewhere herein.

(3) Guide RNA Recognition Sequences and Guide RNA Target Sequences

The term "guide RNA recognition sequence" includes nucleic acid sequences present in a target DNA (e.g., the HSD17B13 gene) to which a DNA-targeting segment of a gRNA will bind, provided sufficient conditions for binding exist. The term guide RNA recognition sequence as used herein encompasses both strands of the target double-stranded DNA (i.e., the sequence on the complementary strand to which the guide RNA hybridizes and the corresponding sequence on the non-complementary strand adjacent to the protospacer adjacent motif (PAM)). The term "guide RNA target sequence" as used herein refers specifically to the sequence on the non-complementary strand adjacent to the PAM (i.e., upstream or 5' of the PAM). That is, the guide RNA target sequence refers to the sequence on the non-complementary strand corresponding to the sequence to which the guide RNA hybridizes on the complementary strand. A guide RNA target sequence is equivalent to the DNA-targeting segment of a guide RNA, but with thymines instead of uracils. As one example, a guide RNA target sequence for a Cas9 enzyme would refer to the sequence on the non-complementary strand adjacent to the 5'-NGG-3' PAM. Guide RNA recognition sequences include sequences to which a guide RNA is designed to have complementarity, where hybridization between the complementary strand of a guide RNA recognition sequence and a DNA targeting sequence of a guide RNA promotes the formation of a CRISPR complex. Full complementarity is not necessarily required, provided that there is sufficient complementarity to cause hybridization and promote formation of a CRISPR complex. Guide RNA recognition sequences or guide RNA target sequences also include cleavage sites for Cas proteins, described in more detail below. A guide RNA recognition sequence or guide RNA target sequence can comprise any polynucleotide, which can be located, for example, in the nucleus or cytoplasm of a cell or within an organelle of a cell, such as a mitochondrion or chloroplast.

The guide RNA recognition sequence within a target DNA can be targeted by (i.e., be bound by, or hybridize with, or be complementary to) a Cas protein or a gRNA. Suitable DNA/RNA binding conditions include physiological conditions normally present in a cell. Other suitable DNA/RNA binding conditions (e.g., conditions in a cell-free system) are known (see, e.g., Molecular Cloning: A Laboratory Manual, 3rd Ed. (Sambrook et al., Harbor Laboratory Press 2001), herein incorporated by reference in its entirety for all purposes). The strand of the target DNA that is complementary to and hybridizes with the Cas protein or gRNA can be called the "complementary strand," and the strand of the target DNA that is complementary to the "complementary strand" (and is therefore not complementary to the Cas protein or gRNA) can be called "non-complementary strand" or "template strand."

The Cas protein can cleave the nucleic acid at a site within or outside of the nucleic acid sequence present in the target DNA to which the DNA-targeting segment of a gRNA will bind. The "cleavage site" includes the position of a nucleic acid at which a Cas protein produces a single-strand break or a double-strand break. For example, formation of a CRISPR complex (comprising a gRNA hybridized to the complementary strand of a guide RNA recognition sequence and complexed with a Cas protein) can result in cleavage of one or both strands in or near (e.g., within 1, 2, 3, 4, 5, 6, 7, 8, 9, 10, 20, 50, or more base pairs from) the nucleic acid sequence present in a target DNA to which a DNA-targeting segment of a gRNA will bind. If the cleavage site is outside of the nucleic acid sequence to which the DNA-targeting segment of the gRNA will bind, the cleavage site is still considered to be within the "guide RNA recognition sequence" or guide RNA target sequence. The cleavage site can be on only one strand or on both strands of a nucleic acid. Cleavage sites can be at the same position on both strands of the nucleic acid (producing blunt ends) or can be at different sites on each strand (producing staggered ends (i.e., overhangs)). Staggered ends can be produced, for example, by using two Cas proteins, each of which produces a single-strand break at a different cleavage site on a different strand, thereby producing a double-strand break. For example, a first nickase can create a single-strand break on the first strand of double-stranded DNA (dsDNA), and a second nickase can create a single-strand break on the second strand of dsDNA such that overhanging sequences are created. In some cases, the guide RNA recognition sequence or guide RNA target sequence of the nickase on the first strand is separated from the guide RNA recognition sequence or guide RNA target sequence of the nickase on the second strand by at least 2, 3, 4, 5, 6, 7, 8, 9, 10, 15, 20, 25, 30, 40, 50, 75, 100, 250, 500, or 1,000 base pairs.

Site-specific binding and/or cleavage of target DNA by Cas proteins can occur at locations determined by both (i) base-pairing complementarity between the gRNA and the target DNA and (ii) a short motif, called the protospacer adjacent motif (PAM), in the target DNA. The PAM can flank the guide RNA target sequence on the non-complementary strand opposite of the strand to which the guide RNA hybridizes. Optionally, the guide RNA target sequence can be flanked on the 3' end by the PAM. Alternatively, the guide RNA target sequence can be flanked on the 5' end by the PAM. For example, the cleavage site of Cas proteins can be about 1 to about 10 or about 2 to about 5 base pairs (e.g., 3 base pairs) upstream or downstream of the PAM sequence. In some cases (e.g., when Cas9 from S pybgenes or a closely related Cas9 is used), the PAM sequence of the non-complementary strand can be 5'-$N_1$GG-3', where $N_1$ is any DNA nucleotide and is immediately 3' of the guide RNA recognition sequence of the non-complementary strand of the target DNA (i.e., immediately 3' of the guide RNA target sequence). As such, the PAM sequence of the complementary strand would be 5'-CC$N_2$-3', where $N_2$ is any DNA nucleotide and is immediately 5' of the guide RNA recognition sequence of the complementary strand of the target DNA. In some such cases, $N_1$ and $N_2$ can be complementary and the $N_1$-$N_2$ base pair can be any base pair (e.g., $N_1$=C and $N_2$=G; $N_1$=G and $N_2$=C; $N_1$=A and $N_2$=T; or $N_1$=T, and $N_2$=A). In the case of Cas9 from *S. aureus*, the PAM can be NNGRRT or NNGRR, where N can be A, G, C, or T, and R can be G or A. In some cases (e.g., for FnCpf1), the PAM sequence can be upstream of the 5' end and have the sequence 5'-TFN-3'.

Examples of guide RNA target sequences or guide RNA target sequences in addition to a PAM sequence are provided below. For example, the guide RNA target sequence can be a 20-nucleotide DNA sequence immediately preceding an NGG motif recognized by a Cas9 protein. Examples of such guide RNA target sequence plus a PAM sequence are GN19NGG (SEQ ID NO: 248) or $N_{20}$NGG (SEQ ID NO: 249). See, e.g., WO 2014/165825, herein incorporated by reference in its entirety for all purposes. The guanine at the 5' end can facilitate transcription by RNA polymerase in cells. Other examples of guide RNA target sequences plus a PAM sequence can include two guanine nucleotides at the 5' end (e.g., $GGN_{20}$NGG; SEQ ID NO: 250) to facilitate efficient transcription by T7 polymerase in vitro. See. e.g., WO 2014/065596, herein incorporated by reference in its entirety for all purposes. Other guide RNA target sequences plus a PAM sequence can have between 4-22 nucleotides in length of SEQ ID NOS: 248-250, including the 5' G or GG and the 3' GG or NGG. Yet other guide RNA target sequences can have between 14 and 20 nucleotides in length of SEQ ID NOS: 248-250.

The guide RNA recognition sequence or guide RNA target sequence can be any nucleic acid sequence endogenous or exogenous to a cell. The guide RNA recognition sequence or guide RNA target sequence can be a sequence coding a gene product (e.g., a protein) or a non-coding sequence (e.g., a regulatory sequence) or can include both.

As one example, the guide RNA recognition sequence or guide RNA target sequence can be within a region corresponding to exon 6 and/or intron 6, exon 6 and/or exon 7, or exon 6 and/or intron 6 and/or exon 7 of SEQ ID NO: 2 when the HSD17B13 gene is optimally aligned with SEQ ID NO: 2. As another example, the guide RNA recognition sequence or guide RNA target sequence can include or is proximate to a position corresponding to position 12666 of SEQ ID NO: 2 when the HSD17B13 gene is optimally aligned with SEQ ID NO: 2. For example, the guide RNA recognition sequence or guide RNA target sequence can be within about 1000, 500, 400, 300, 200, 100, 50, 45, 40, 35, 30, 25, 20, 15, 10, or 5 nucleotides of the position corresponding to position 12666 of SEQ ID NO: 2 when the HSD17B13 gene is optimally aligned with SEQ ID NO: 2. As yet another example, the guide RNA recognition sequence or guide RNA target sequence can include or be proximate to the start codon of an HSD17B13 gene or the stop codon of an HSD17B13 gene. For example, the guide RNA recognition sequence or guide RNA target sequence can be within about 10, 20, 30, 40, 50, 100, 200, 300, 400, 500, or 1,000 nucleotides of the start codon or the stop codon. Examples of such guide RNA target sequences and of guide RNAs targeting such guide RNA target sequences are disclosed elsewhere herein.

F. Exogenous Donor Sequences or Targeting Vectors

The methods and compositions disclosed herein can utilize exogenous donor sequences (e.g., targeting vectors or repair templates) to modify an HSD17B13 gene, either without cleavage of the HSD17B13 gene or following cleavage of the HSD17B13 gene with a nuclease agent. An exogenous donor sequence refers to any nucleic acid or vector that includes the elements that are required to enable site-specific recombination with a target sequence. Using exogenous donor sequences in combination with nuclease agents may result in more precise modifications within the HSD17B13 gene by promoting homology-directed repair.

In such methods, the nuclease agent cleaves the HSD17B13 gene to create a single-strand break (nick) or double-strand break, and the exogenous donor sequence recombines the HSD17B13 gene via non-homologous end joining (NHEJ)-mediated ligation or through a homology-directed repair event. Optionally, repair with the exogenous donor sequence removes or disrupts the nuclease cleavage site so that alleles that have been targeted cannot be re-targeted by the nuclease agent.

Exogenous donor sequences can comprise deoxyribonucleic acid (DNA) or ribonucleic acid (RNA), they can be single-stranded or double-stranded, and they can be in linear or circular form. For example, an exogenous donor sequence can be a single-stranded oligodeoxynucleotide (ssODN). See, e.g., Yoshimi et al. (2016) *Nat. Commun.* 7.10431, herein incorporated by reference in its entirety for all purposes. An exemplary exogenous donor sequence is between about 50 nucleotides to about 5 kb in length, is between about 50 nucleotides to about 3 kb in length, or is between about 50 to about 1,000 nucleotides in length. Other exemplary exogenous donor sequences are between about 40 to about 200 nucleotides in length. For example, an exogenous donor sequence can be between about 50 to about 60, about 60 to about 70, about 70 to about 80, about 80 to about 90, about 90 to about 100, about 100 to about 110, about 110 to about 120, about 120 to about 130, about 130 to about 140, about 140 to about 150, about 150 to about 160, about 160 to about 170, about 170 to about 180, about 180 to about 190, or about 190 to about 200 nucleotides in length. Alternatively, an exogenous donor sequence can be between about 50 to about 100, about 100 to about 200, about 200 to about 300, about 300 to about 400, about 400 to about 500, about 500 to about 600, about 600 to about 700, about 700 to about 800, about 800 to about 900, or about 900 to about 1,000 nucleotides in length. Alternatively, an exogenous donor sequence can be between about 1 kb to about 1.5 kb, about 1.5 kb to about 2 kb, about 2 kb to about 2.5 kb, about 2.5 kb to about 3 kb, about 3 kb to about 3.5 kb, about 3.5 kb to about 4 kb, about 4 kb to about 4.5 kb, or about 4.5 kb to about 5 kb in length. Alternatively, an exogenous donor sequence can be, for example, no more than 5 kb, 4.5 kb, 4 kb, 3.5 kb, 3 kb, 2.5 kb, 2 kb, 1.5 kb, 1 kb, 900 nucleotides, 800 nucleotides, 700 nucleotides, 600 nucleotides, 500 nucleotides, 400 nucleotides, 300 nucleotides, 200 nucleotides, 100 nucleotides, or 50 nucleotides in length.

In one example, an exogenous donor sequence is an ssODN that is between about 80 nucleotides and about 200 nucleotides in length (e.g., about 120 nucleotides in length). In another example, an exogenous donor sequences is an ssODN that is between about 80 nucleotides and about 3 kb in length. Such an ssODN can have homology arms, for example, that are each between about 40 nucleotides and about 60 nucleotides in length. Such an ssODN can also have homology arms, for example, that are each between about 30 nucleotides and 100 nucleotides in length. The homology arms can be symmetrical (e.g., each 40 nucleotides or each 60 nucleotides in length), or they can be asymmetrical (e.g., one homology arm that is 36 nucleotides in length, and one homology arm that is 91 nucleotides in length).

Exogenous donor sequences can include modifications or sequences that provide for additional desirable features (e.g., modified or regulated stability; tracking or detecting with a fluorescent label; a binding site for a protein or protein complex; and so forth). Exogenous donor sequences can comprise one or more fluorescent labels, purification tags, epitope tags, or a combination thereof. For example, an exogenous donor sequence can comprise one or more fluorescent labels (e.g., fluorescent proteins or other fluorophores or dyes), such as at least 1, at least 2, at least 3, at least 4, or at least 5 fluorescent labels. Exemplary fluorescent labels include fluorophores such as fluorescein (e.g., 6-carboxyfluorescein (6-FAM)), Texas Red, HEX, Cy3, Cy5, Cy5.5, Pacific Blue, 5-(and -6)-carboxytetramethylrhodamine (TAMRA), and Cy7. A wide range of fluorescent dyes are available commercially for labeling oligonucleotides (e.g., from Integrated DNA Technologies). Such fluorescent labels (e.g., internal fluorescent labels) can be used, for example, to detect an exogenous donor sequence that has been directly integrated into a cleaved HSD17B13 gene having protruding ends compatible with the ends of the exogenous donor sequence. The label or tag can be at the 5' end, the 3' end, or internally within the exogenous donor sequence. For example, an exogenous donor sequence can be conjugated at 5' end with the IR700 fluorophore from Integrated DNA Technologies (5'IRDYE®700).

Exogenous donor sequences can also comprise nucleic acid inserts including segments of DNA to be integrated in the HSD17B13 gene. Integration of a nucleic acid insert in the HSD17B13 gene can result in addition of a nucleic acid sequence of interest in the HSD17B13 gene, deletion of a nucleic acid sequence of interest in the HSD17B13 gene, or replacement of a nucleic acid sequence of interest in the HSD17B13 gene (i.e., deletion and insertion). Some exogenous donor sequences are designed for insertion of a nucleic acid insert in the HSD17B13 gene without any corresponding deletion in the HSD17B13 gene. Other exogenous donor sequences are designed to delete a nucleic acid sequence of interest in the HSD17B13 gene without any corresponding insertion of a nucleic acid insert. Yet other exogenous donor sequences are designed to delete a nucleic acid sequence of interest in the HSD17B13 gene and replace it with a nucleic acid insert.

The nucleic acid insert or the corresponding nucleic acid in the HSD17B13 gene being deleted and/or replaced can be various lengths. An exemplary nucleic acid insert or corresponding nucleic acid in the HSD17B13 gene being deleted and/or replaced is between about 1 nucleotide to about 5 kb in length or is between about 1 nucleotide to about 1,000 nucleotides in length. For example, a nucleic acid insert or a corresponding nucleic acid in the HSD17B13 gene being deleted and/or replaced can be between about 1 to about 10, about 10 to about 20, about 20 to about 30, about 30 to about 40, about 40 to about 50, about 50 to about 60, about 60 to about 70, about 70 to about 80, about 80 to about 90, about 90 to about 100, about 100 to about 110, about 110 to about 120, about 120 to about 130, about 130 to about 140, about 140 to about 150, about 150 to about 160, about 160 to about 170, about 170 to about 180, about 180 to about 190, or about 190 to about 200 nucleotides in length. Likewise, a nucleic acid insert or a corresponding nucleic acid in the HSD17B13 gene being deleted and/or replaced can be between about 1 to about 100, about 100 to about 200, about 200 to about 300, about 300 to about 400, about 400 to about 500, about 500 to about 600, about 600 to about 700, about 700 to about 800, about 800 to about 900, or about 900 to about 1,000 nucleotides in length. Likewise, a nucleic acid insert or a corresponding nucleic acid in the HSD17B13 gene being deleted and/or replaced can be between about 1 kb to about 1.5 kb, about 1.5 kb to about 2 kb, about 2 kb to about 2.5 kb, about 2.5 kb to about 3 kb, about 3 kb to about 3.5 kb, about 3.5 kb to about 4 kb, about 4 kb to about 4.5 kb, or about 4.5 kb to about 5 kb in length.

The nucleic acid insert can comprise genomic DNA or any other type of DNA. For example, the nucleic acid insert can comprise cDNA.

The nucleic acid insert can comprise a sequence that is homologous to all or part of the HSD17B13 gene (e.g., a portion of the gene encoding a particular motif or region of a HSD17B13 protein). For example, the nucleic acid insert can comprise a sequence that comprises one or more point mutations (e.g., 1, 2, 3, 4, 5, or more) or one or more nucleotide insertions or deletions compared with a sequence targeted for replacement in the HSD17B13 gene.

The nucleic acid insert or the corresponding nucleic acid in the HSD17B13 gene being deleted and/or replaced can be a coding region such as an exon; a non-coding region such as an intron, an untranslated region, or a regulatory region (e.g., a promoter, an enhancer, or a transcriptional repressor-binding element); or any combination thereof.

The nucleic acid insert can also comprise a conditional allele. The conditional allele can be a multifunctional allele, as described in US 2011/0104799, herein incorporated by reference in its entirety for all purposes. For example, the conditional allele can comprise: (a) an actuating sequence in sense orientation with respect to transcription of a target gene; (b) a drug selection cassette (DSC) in sense or antisense orientation; (c) a nucleotide sequence of interest (NSI) in antisense orientation; and (d) a conditional by inversion module (COIN, which utilizes an exon-splitting intron and an invertible gene-trap-like module) in reverse orientation. See, e.g., US 2011/0104799. The conditional allele can further comprise recombinable units that recombine upon exposure to a first recombinase to form a conditional allele that (i) lacks the actuating sequence and the DSC; and (ii) contains the NSI in sense orientation and the COIN in antisense orientation. See, e.g., US 2011/0104799.

Nucleic acid inserts can also comprise a polynucleotide encoding a selection marker. Alternatively, the nucleic acid inserts can lack a polynucleotide encoding a selection marker. The selection marker can be contained in a selection cassette. Optionally, the selection cassette can be a self-deleting cassette. See, e.g., U.S. Pat. No. 8,697,851 and US 2013/03 12129, each of which is herein incorporated by reference in its entirety for all purposes. As an example, the self-deleting cassette can comprise a Crei gene (comprises two exons encoding a Cre recombinase, which are separated by an intron) operably linked to a mouse Prm1 promoter and a neomycin resistance gene operably linked to a human ubiquitin promoter. Exemplary selection markers include neomycin phosphotransferase ($neo^r$), hygromycin B phosphotransferase ($hyg^r$), puromycin-N-acetyltransferase ($puro^r$), blasticidin S deaminase ($bsr^r$), xanthine/guanine phosphoribosyl transferase (gpt), or herpes simplex virus thymidine kinase (HSV-k), or a combination thereof. The polynucleotide encoding the selection marker can be operably linked to a promoter active in a cell being targeted. Examples of promoters are described elsewhere herein.

The nucleic acid insert can also comprise a reporter gene. Exemplary reporter genes include those encoding luciferase, β-galactosidase, green fluorescent protein (GFP), enhanced green fluorescent protein (eGFP), cyan fluorescent protein (CFP), yellow fluorescent protein (YFP), enhanced yellow fluorescent protein (eYFP), blue fluorescent protein (BFP), enhanced blue fluorescent protein (eBFP), DsRed, ZsGreen, MmGFP, mPlum, mCherry, tdTomato, mStrawberry, J-Red, mOrange, mKO, mCitrine, Venus, YPet, Emerald, CyPet, Cerulean, T-Sapphire, and alkaline phosphatase. Such reporter genes can be operably linked to a promoter active in a cell being targeted. Examples of promoters are described elsewhere herein.

The nucleic acid insert can also comprise one or more expression cassettes or deletion cassettes. A given cassette can comprise one or more of a nucleotide sequence of interest, a polynucleotide encoding a selection marker, and a reporter gene, along with various regulatory components that influence expression. Examples of selectable markers and reporter genes that can be included are discussed in detail elsewhere herein.

The nucleic acid insert can comprise a nucleic acid flanked with site-specific recombination target sequences. Alternatively, the nucleic acid insert can comprise one or more site-specific recombination target sequences. Although the entire nucleic acid insert can be flanked by such site-specific recombination target sequences, any region or individual polynucleotide of interest within the nucleic acid insert can also be flanked by such sites. Site-specific recombination target sequences, which can flank the nucleic acid insert or any polynucleotide of interest in the nucleic acid insert can include, for example, 1oxP, 1ox511, 1ox2272, 1ox66, 1ox71, 1oxM2, 1ox5171, FRT, FRT11, FRT71, attp, att, FRT, rox, or a combination thereof. In one example, the site-specific recombination sites flank a polynucleotide encoding a selection marker and/or a reporter gene contained within the nucleic acid insert. Following integration of the nucleic acid insert in the HSD17B13 gene, the sequences between the site-specific recombination sites can be removed. Optionally, two exogenous donor sequences can be used, each with a nucleic acid insert comprising a site-specific recombination site. The exogenous donor sequences can be targeted to 5' and 3' regions flanking a nucleic acid of interest. Following integration of the two nucleic acid inserts into the target genomic locus, the nucleic acid of interest between the two inserted site-specific recombination sites can be removed.

Nucleic acid inserts can also comprise one or more restriction sites for restriction endonucleases (i.e., restriction enzymes), which include Type I, Type II, Type III, and Type N endonucleases. Type I and Type Ill restriction endonucleases recognize specific recognition sequences, but typically cleave at a variable position from the nuclease binding site, which can be hundreds of base pairs away from the cleavage site (recognition sequence). In Type II systems the restriction activity is independent of any methylase activity, and cleavage typically occurs at specific sites within or near to the binding site. Most Type II enzymes cut palindromic sequences, however Type IIa enzymes recognize non-palindromic recognition sequences and cleave outside of the recognition sequence, Type IIb enzymes cut sequences twice with both sites outside of the recognition sequence, and Type Its enzymes recognize an asymmetric recognition sequence and cleave on one side and at a defined distance of about 1-20 nucleotides from the recognition sequence. Type IV restriction enzymes target methylated DNA. Restriction enzymes are further described and classified, for example in the REBASE database (webpage at rebase.neb.com, Roberts et al., (2003) *Nucleic Acids Res.* 31:418-420; Roberts et al., (2003) *Nucleic Acids Res.* 31:1805-1812; and Belfort et al. (2002) in Mobile DNA I1, pp. 761-783, Eds. Craigie et al., (ASM Press, Washington, DC)).

(1) Donor Sequences for Non-Honsologous-End-Joining-Mediated Insertion

Some exogenous donor sequences have short single-stranded regions at the 5' end and/or the 3' end that are complementary to one or more overhangs created by nuclease-mediated or Cas-protein-mediated cleavage at the target genomic locus (e.g., in the HSD17B13 gene). These overhangs can also be referred to as 5' and 3' homology arms. For example, some exogenous donor sequences have short single-stranded regions at the 5' end and/or the 3' end that are complementary to one or more overhangs created by Cas-protein-mediated cleavage at 5' and/or 3' target sequences at the target genomic locus. Some such exogenous donor sequences have a complementary region only at the 5' end or only at the 3' end. For example, some such exogenous donor sequences have a complementary region only at the 5' end complementary to an overhang created at a 5' target sequence at the target genomic locus or only at the 3' end complementary to an overhang created at a 3' target sequence at the target genomic locus. Other such exogenous donor sequences have complementary regions at both the 5' and 3' ends. For example, other such exogenous donor sequences have complementary regions at both the 5' and 3' ends e.g., complementary to first and second overhangs, respectively, generated by Cas-mediated cleavage at the target genomic locus. For example, if the exogenous donor sequence is double-stranded, the single-stranded complementary regions can extend from the 5' end of the top strand of the donor sequence and the 5' end of the bottom strand of the donor sequence, creating 5' overhangs on each end. Alternatively, the single-stranded complementary region can extend from the 3' end of the top strand of the donor sequence and from the 3' end of the bottom strand of the template, creating 3' overhangs.

The complementary regions can be of any length sufficient to promote ligation between the exogenous donor sequence and the HSD17B13 gene. Exemplary complementary regions are between about 1 to about 5 nucleotides in length, between about 1 to about 25 nucleotides in length, or between about 5 to about 150 nucleotides in length. For example, a complementary region can be at least about 1, 2, 3, 4, 5, 6, 7, 8, 9, 10, 11, 12, 13, 14, 15, 16, 17, 18, 19, 20, 21, 22, 23, 24, or 25 nucleotides in length. Alternatively, the complementary region can be about 5 to about 10, about 10 to about 20, about 20 to about 30, about 30 to about 40, about 40 to about 50, about 50 to about 60, about 60 to about 70, about 70 to about 80, about 80 to about 90, about 90 to about 100, about 100 to about 110, about 110 to about 120, about 120 to about 130, about 130 to about 140, about 140 to about 150 nucleotides in length, or longer.

Such complementary regions can be complementary to overhangs created by two pairs of nickases. Two double-strand breaks with staggered ends can be created by using first and second nickases that cleave opposite strands of DNA to create a first double-strand break, and third and fourth nickases that cleave opposite strands of DNA to create a second double-strand break. For example, a Cas protein can be used to nick first, second, third, and fourth guide RNA target sequences corresponding with first, second, third, and fourth guide RNAs. The first and second guide RNA target sequences can be positioned to create a first cleavage site such that the nicks created by the first and second nickases on the first and second strands of DNA create a double-strand break (i.e., the first cleavage site comprises the nicks within the first and second guide RNA target sequences). Likewise, the third and fourth guide RNA target sequences can be positioned to create a second cleavage site such that the nicks created by the third and fourth nickases on the first and second strands of DNA create a double-strand break (i.e., the second cleavage site comprises the nicks within the third and fourth guide RNA target sequences). Preferably, the nicks within the first and second guide RNA target sequences and/or the third and fourth guide RNA target sequences can be off-set nicks that create overhangs. The offset window can be, for example, at least about 5 bp, 10 bp, 20 bp, 30 bp, 40 bp, 50 bp, 60 bp, 70 bp, 80 bp, 90 bp, 100 bp or more. See Ran et al. (2013) Cell 154:1380-1389; *Mali* et al. (2013) Nat. Biotech. 31:833-838; and Shen et al. (2014) Mat. Methods 11:399-404, each of which is herein incorporated by reference in its entirety for all purposes. In such cases, a double-stranded exogenous donor sequence can be designed with single-stranded complementary regions that are complementary to the overhangs created by the nicks within the first and second guide RNA target sequences and by the nicks within the third and fourth guide RNA target sequences. Such an exogenous donor sequence can then be inserted by non-homologous-end-joining-mediated ligation.

(2) Donor Sequences for Insertion by Homology-Directed Repair

Some exogenous donor sequences (i.e., targeting vectors) comprise homology arms. If the exogenous donor sequence also comprises a nucleic acid insert, the homology arms can flank the nucleic acid insert. For ease of reference, the homology arms are referred to herein as 5' and 3' (i.e., upstream and downstream) homology arms. This terminology relates to the relative position of the homology arms to the nucleic acid insert within the exogenous donor sequence. The 5' and 3' homology arms correspond to regions within the HSD17B13 gene, which are referred to herein as "5' target sequence" and "3' target sequence," respectively.

A homology arm and a target sequence "correspond" or are "corresponding" to one another when the two regions share a sufficient level of sequence identity to one another to act as substrates for a homologous recombination reaction. The term "homology" includes DNA sequences that are either identical or share sequence identity to a corresponding sequence. The sequence identity between a given target sequence and the corresponding homology arm found in the exogenous donor sequence can be any degree of sequence identity that allows for homologous recombination to occur. For example, the amount of sequence identity shared by the homology arm of the exogenous donor sequence (or a fragment thereof) and the target sequence (or a fragment thereof) can be at least 50%, 55%, 60%, 65%, 70%, 75%, 80%, 81%, 82%, 83%, 84%, 85%, 86%, 87%, 88%, 89%, 90%, 91%, 92%, 93%, 94%, 95%, 96%, 97%, 98%, 99% or 100% sequence identity, such that the sequences undergo homologous recombination. Moreover, a corresponding region of homology between the homology arm and the corresponding target sequence can be of any length that is sufficient to promote homologous recombination. Exemplary homology arms are between about 25 nucleotides to about 2.5 kb in length, are between about 25 nucleotides to about 1.5 kb in length, or are between about 25 to about 500 nucleotides in length. For example, a given homology arm (or each of the homology arms) and/or corresponding target sequence can comprise corresponding regions of homology that are between about 25 to about 30, about 30 to about 40, about 40 to about 50, about 50 to about 60, about 60 to about 70, about 70 to about 80, about 80 to about 90, about 90 to about 100, about 100 to about 150, about 150 to about 200, about 200 to about 250, about 250 to about 300, about 300 to about 350, about 350 to about 400, about 400 to about 450, or about 450 to about 500 nucleotides in length, such that the homology arms have sufficient homology to undergo homologous recombination with the corresponding target sequences within the HSD17B13 gene. Alternatively, a given homology arm (or each homology arm) and/or corresponding target sequence can comprise corresponding regions of homology that are between about 0.5 kb to about 1 kb, about 1 kb to about 1.5 kb, about 1.5 kb to about 2 kb, or about 2 kb to about 2.5 kb in length. For example, the homology arms can each be about 750 nucleotides in length. The homology arms can be symmetrical (each about the same size in length), or they can be asymmetrical (one longer than the other).

The homology arms can correspond to a locus that is native to a cell (e.g., the targeted locus). Alternatively, for example, they can correspond to a region of a heterologous or exogenous segment of DNA that was integrated into the genome of the cell, including, for example, transgenes, expression cassettes, or heterologous or exogenous regions of DNA. Alternatively, the homology arms of the targeting vector can correspond to a region of a yeast artificial chromosome (YAC), a bacterial artificial chromosome (BAC), a human artificial chromosome, or any other engineered region contained in an appropriate host cell. Still further, the homology arms of the targeting vector can correspond to or be derived from a region of a BAC library, a cosmid library, or a P1 phage library, or can be derived from synthetic DNA.

When a nuclease agent is used in combination with an exogenous donor sequence, the 5' and 3' target sequences are preferably located in sufficient proximity to the nuclease cleavage site so as to promote the occurrence of a homologous recombination event between the target sequences and the homology arms upon a single-strand break (nick) or double-strand break at the nuclease cleavage site. The term "nuclease cleavage site" includes a DNA sequence at which a nick or double-strand break is created by a nuclease agent (e.g., a Cas9 protein complexed with a guide RNA). The target sequences within the HSD17B13 gene that correspond to the 5' and 3' homology arms of the exogenous donor sequence are "located in sufficient proximity" to a nuclease cleavage site if the distance is such as to promote the occurrence of a homologous recombination event between the 5' and 3' target sequences and the homology arms upon a single-strand break or double-strand break at the nuclease cleavage site. Thus, the target sequences corresponding to the 5' and/or 3' homology arms of the exogenous donor sequence can be, for example, within at least 1 nucleotide of a given nuclease cleavage site or within at least 10 nucleotides to about 1,000 nucleotides of a given nuclease cleavage site. As an example, the nuclease cleavage site can be immediately adjacent to at least one or both of the target sequences.

The spatial relationship of the target sequences that correspond to the homology arms of the exogenous donor sequence and the nuclease cleavage site can vary. For example, target sequences can be located 5' to the nuclease cleavage site, target sequences can be located 3' to the nuclease cleavage site, or the target sequences can flank the nuclease cleavage site.

IV. Therapeutic and Prophylactic Applications

Also provided are therapeutic methods and methods of treatment or prophylaxis of a chronic liver disease in a subject having or at risk for the disease using the methods disclosed herein for modifying or altering expression of an endogenous HSD17B13 gene. Also provided are therapeutic methods and methods of treatment or prophylaxis of a liver disease such as an alcoholic liver disease or a nonalcoholic liver disease in a subject having or at risk for the disease using the methods disclosed herein for modifying or altering expression of an endogenous HSD17B13 gene. Also provided are therapeutic methods and methods of treatment or prophylaxis of a chronic liver disease in a subject having or at risk for the disease using methods for decreasing expression of HSD17B13 mRNA transcripts or using methods for providing recombinant nucleic acids encoding HSD17B13 proteins, providing mRNAs encoding HSD17B13 proteins, or providing HSD17B13 proteins to the subject. Also provided are therapeutic methods and methods of treatment or prophylaxis of a liver disease such as an alcoholic liver disease or a nonalcoholic liver disease in a subject having or at risk for the disease using methods for decreasing expression of HSD17B13 mRNA transcripts or using methods for providing recombinant nucleic acids encoding HSD17B13 proteins, providing mRNAs encoding HSD17B13 proteins, or providing HSD17B13 proteins to the subject. The methods can comprise introducing one or more nucleic acids or proteins into the subject, into the liver of the subject, or into a cell (e.g., liver cell) of the subject (e.g., in vivo or ex vivo).

Chronic liver diseases include diseases of the liver which last over a period of six months and can include, for example, diseases of the liver involving progressive destruction and regeneration of the liver parenchyma that can lead to fibrosis and cirrhosis. Chronic liver diseases can be alcoholic liver diseases or nonalcoholic liver diseases. Liver pathologies encompassed by chronic liver diseases can include, for example, inflammation (e.g., chronic hepatitis), liver cirrhosis, and hepatocellular carcinoma. Types of chronic liver disease are disclosed elsewhere herein and include, for example, fatty liver disease, nonalcoholic fatty liver disease, alcoholic fatty liver disease, cirrhosis, and hepatocellular carcinoma. Symptoms and signs of chronic liver diseases are known and can include, for example, enlarged liver, fatigue, pain in the upper right abdomen, abdominal swelling (ascites), enlarged blood vessels just beneath the skin's surface, enlarged breasts in men, enlarged spleen, red palms, and yellowing of the skin and eyes (jaundice). Testing for chronic liver diseases can involve blood tests, imaging of the liver, and biopsy of the liver. An individual is at increased risk of a chronic liver disease if the subject has at least one known risk-factor (e.g., genetic factor such as a disease-causing mutation) placing individuals with that risk factor at a statistically significant greater risk of developing the disease than individuals without the risk factor. Risk factors for chronic liver diseases are also well known and can include, for example, excessive alcohol use, obesity, high cholesterol, high levels of triglycerides in the blood, polycystic ovary syndrome, sleep apnea, type 2 diabetes, underactive thyroid (hypothyroidism), underactive pituitary gland (hypopituitarism), and metabolic syndromes including raised blood lipids.

The term "subject" includes human and other mammalian subjects (e.g., feline, canine, rodent, mouse, or rat) or non-mammalian subjects (e.g., poultry) that receive either prophylactic or therapeutic treatment. Such subjects can be, for example, a subject (e.g., a human) who is not a carrier of the HSD17B13 rs72613567 variant (or is only a heterozygous carrier of the HSD17B13 rs72613567 variant) and has or is susceptible to developing a chronic liver disease. Various methods are possible for detecting the presence of the HSD17B13 rs72613567 variant in a biological sample comprising genomic DNA, for detecting the presence or levels of any one of or a combination of HSD17B13 Transcripts C, D, E, F, F', G, and H, and particularly D, in a biological sample comprising mRNA or cDNA, or for detecting the presence or levels of any one of or a combination of HSD17B13 protein Isoforms C, D, E, F, F', G, or H, and particularly D, in a biological sample comprising protein. Methods for detecting the presence of a sequence in genomic DNA and for detecting the presence of a particular mRNA transcript or protein isoform are well-known. It is understood that gene sequences within a population and mRNAs and proteins encoded by such genes can vary due to polymorphisms such as single-nucleotide polymorphisms. The sequences provided herein for the HSD17B13 gene and for each HSD17B13 Transcript and HSD17B13 Isoform are only exemplary sequences for the HSD17B13 gene and for each HSD17B13 Transcript and HSD17B13 isoform. Other sequences for the HSD17B13 gene and for each HSD17B13 Transcript and HSD17B13 Isoform are also possible.

For example, a method for detecting an HSD17B13 rs72613567 variant in a cell or in a subject such as a human subject can comprise, for example, obtaining a biological sample from the subject comprising an HSD17B13 gene, and performing an assay on the biological sample that determines that a position of the HSD17B13 gene corresponding to position 12666 of SEQ ID NO: 2 when the HSD17B13 gene and SEQ ID NO: 2 are optimally aligned is occupied by a thymine or that a thymine is inserted between positions corresponding to positions 12665 and 12666 when the HSD17B13 gene and SEQ ID NO: 1 are optimally aligned. It is understood that determining that a position of the HSD17B13 gene corresponding to position 12666 of SEQ ID NO: 2 when the HSD17B13 gene and SEQ ID NO: 2 are optimally aligned is occupied by a thymine means that the identity of a sufficient number of nucleotides is determined in the positions flanking the positions corresponding to positions 12665 and 12666 of SEQ ID NO: 1 that it can be determined that a thymine is inserted between the positions corresponding to positions 12665 and 12666 of SEQ ID NO: 1. Such assays can comprise, for example determining the identity of positions of the HSD17B13 gene corresponding to position 12666 of SEQ ID NO: 2 (or positions 12665 and 12666 of SEQ ID NO: 1) and one or more surrounding positions (e.g., at least 1, 2, 3, 4, 5, 6, 7, 8, 9, or 10 positions flanking one side or each side of position 12666 of SEQ ID NO: 2 or positions 12665 and 12666 of SEQ ID NO: 1) when the HSD17B13 gene and SEQ ID NO: 2 (or SEQ ID NO: 1) are optimally aligned. The assay in such a method can comprise, for example, sequencing a portion of the HSD17B13 gene including a position corresponding to position 12666 or positions 12666 and 12667 of SEQ ID NO: 2 when the HSD17B13 gene and SEQ ID NO: 2 are optimally aligned. Likewise, the assay can comprise sequencing a portion of the HSD17B13 gene including positions corresponding to positions 12665 and 12666 of SEQ ID NO: 1 when the HSD17B13 gene and SEQ ID NO: 1 are optimally aligned. Alternatively, the assay in such a method can comprise contacting the biological sample with a primer or probe that specifically hybridizes to the HSD17B13 rs72613567 variant and not the corresponding wild type HSD17B13 sequence (e.g., under stringent conditions), and determining whether hybridization has occurred.

Such methods can comprise genome editing or gene therapy. For example, an endogenous HSD17B13 gene that is not the HSD17B13 rs72613567 variant can be modified to comprise the variation associated with the HSD17B13 rs72613567 variant (i.e., an insertion of a thymine between nucleotides corresponding to positions 12665 and 12666 of SEQ ID NO: 1 when the HSD17B13 gene is optimally aligned with SEQ ID NO: 1, or an insertion of an adenine at the corresponding position on the opposite strand). As another example, an endogenous HSD17B13 gene that is not the HSD17B13 rs72613567 variant can be knocked out or inactivated. Likewise, an endogenous HSD17B13 gene that is not the HSD17B13 rs72613567 variant can be knocked out or inactivated, and an HSD17B13 gene comprising the modification associated with the HSD17B13 rs72613567 variant (e.g., the full HSD17B13 rs72613567 variant or a minigene comprising the modification) can be introduced and expressed. Similarly, an endogenous HSD17B13 gene that is not the HSD17B13 rs72613567 variant can be knocked out or inactivated, and a recombinant DNA encoding any one of or any combination of HSD17B13 Isoforms C, D, F, G, and H (or fragments thereof) can be introduced and expressed, an mRNA encoding any one of or any combination of HSD17B13 Isoforms C, D, F, G, and H (or fragments thereof) can be introduced and expressed (e.g., intracellular protein replacement therapy), or any one of or any combination of HSD17B13 Isoforms C, D, F, G, and H (or fragments thereof) can be introduced (e.g., protein replacement therapy). In particular embodiments, the combination of HSD17B13 Isoforms (or DNA or mRNA encoding) is a combination comprising HSD17B13 Isoform D (e.g., D, DC, DF, DG, DH, DCF, DCG, DCH, DFG, DFH, DGH, DCFG, DCFH, DCGH, DFGH, or DCFGH).

Other such methods can comprise introducing and expressing a recombinant HSD17B13 gene comprising the modification associated with the HSD17B13 rs72613567 variant (e.g., the full HSD17B13 rs72613567 variant or a minigene comprising the modification), introducing and expressing recombinant nucleic acids (e.g., DNA) encoding any one of or any combination of HSD17B13 Isoforms C, D, F, G, and H or fragments thereof, introducing and expressing one or more mRNAs encoding any one of or any combination of HSD17B13 Isoforms C, D, F, G, and H or fragments thereof (e.g., intracellular protein replacement therapy), or introducing any one of or any combination of HSD17B13 Isoforms C, D, F, G, and H or fragments thereof (e.g., protein replacement therapy) without knocking out or inactivating an endogenous HSD17B13 gene that is not the HSD17B13 rs72613567 variant. In particular embodiments, the combination of HSD17B13 isoforms (or DNA or mRNA encoding) is a combination comprising HSD17B13 Isoform D (e.g., D, DC, DF, DG, DH, DCF, DCG, DCH, DFG, DFH, DGH, DCFG, DCFH, DCGH, DFGH, or DCFGH). Optionally, such methods can also be done in combination with methods in which an HSD17B13 transcript whose expression decreases in carriers of the HSD17B13 rs72613567 variant (e.g., Transcripts A, B, E, and F') is targeted for reduced expression, such as through use of anti sense RNA, siRNA, or shRNA. In particular embodiments, the HSD17B13 transcripts targeted for reduced expression are a combination comprising Transcript A (e.g., A, AB, AE, AF', ABE, ABF', AEF', or ABEF').

An HSD17B13 gene or minigene or a DNA encoding any one of or any combination of HSD17B13 Isoforms C, D, F, G, and H or fragments thereof can be introduced and expressed in the form of an expression vector that does not modify the genome, it can be introduced in the form of a targeting vector such that it genomically integrates into an HSD17B13 locus, or it can be introduced such that it genomically integrates into a locus other than the HSD17B13 locus, such as a safe harbor locus. The genomically integrated HSD17B13 gene can be operably linked to an HSD17B13 promoter or to another promoter, such as an endogenous promoter at the site of integration. Safe harbor loci are chromosomal sites where transgenes can be stably and reliably expressed in all tissues of interest without adversely affecting gene structure or expression. Safe harbor loci can have, for example, one or more or all of the following characteristics: (1) distance of greater than 50 kb from the 5' end of any gene; distance of greater than 300 kb from any cancer-related gene; distance of greater than 300 kb from any microRNA; outside a gene transcription unit, and outside of ultra-conserved regions. Examples of suitable safe harbor loci include adeno-associated virus site 1 (AAVS 1), the chemokine (CC motif) receptor 5 (CCRS) gene locus, and the human orthologue of mouse ROSA26 locus.

Combinations of HSD17B13 protein isoforms or nucleic acids encoding HSD17B13 protein isoforms that can be introduced and expressed include, for example, C, D, F, G, H, CD, CF, CG, CH, DF, DG, DH, FG, FH, GH, CDF, CDG, CDH, CFG, CFH, CGH, DFG, DFH, DGH, FGH, CDFG, CDFH, CFGH, DFGH, and CDFGH. In particular methods, HSD17B13 Isoform D or a nucleic acid encoding Isoform D (alone or in combination with other isoforms) is introduced or expressed. Exemplary sequences for each of these isoforms and transcripts are provided elsewhere herein. It is understood, however, that gene sequences and within a population, mRNA sequences transcribed from such genes, and proteins translated from such mRNAs can vary due to polymorphisms such as single-nucleotide polymorphisms. The sequences provided herein for each transcript and isoform are only exemplary sequences. Other sequences are also possible.

Combinations of HSD17B13 Transcripts whose expression can be targeted for reduction through antisense RNA, shRNA, or siRNA include, for example, A, B, E, F', AB, AE, AF', BE, BF', ABE, ABF', AEF', BEF', and ABEF'. In particular methods, HSD17B13 Transcript A (alone or in combination with other transcripts) is targeted. For example, the antisense RNA, siRNA, or shRNA can hybridize to a sequence within SEQ ID NO: 4 (HSD17B13 Transcript A). Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the antisense RNA, siRNA, or shRNA hybridizes to a sequence within exon 7 or a sequence spanning the exon 6-exon 7 boundary of SEQ ID NO: 4 (HSD17B13 Transcript A).

For example, some such methods comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: (a) a nuclease agent (or nucleic acid encoding) that binds to a nuclease target sequence within an HSD17B13 gene, wherein the nuclease target sequence includes or is proximate to a position corresponding to position 12666 of SEQ ID NO: 2 when the HSD17B13 gene is optimally aligned with SEQ ID NO: 2, and (b) an exogenous donor sequence comprising a 5' homology arm that hybridizes to a target sequence 5' of the position corresponding to position 12666 of SEQ ID NO: 2, a 3' homology arm that hybridizes to a target sequence 3' of the position corresponding to position 12666 of SEQ ID NO: 2, and a nucleic acid insert comprising a thymine flanked by the 5' homology arm and the 3' homology arm. The nuclease agent can cleave the HSD17B13 gene in a liver cell in the subject, and the exogenous donor sequence can recombine with the HSD17B13 gene in the liver cell, wherein upon recombination of the exogenous donor sequence with the HSD17B13 gene, the thymine is inserted between nucleotides corresponding to positions 12665 and 12666 of SEQ ID NO: 1 when the HSD17B13 gene is optimally aligned with SEQ ID NO: 1. Examples of nuclease agents (e.g., a Cas9 protein and a guide RNA) that can be used in such methods are disclosed elsewhere herein. Examples of suitable guide RNAs and guide RNA target sequences are disclosed elsewhere herein. Examples of exogenous donor sequences that can be used in such methods are disclosed elsewhere herein.

As another example, some such methods comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject an exogenous donor sequence comprising a 5' homology arm that hybridizes to a target sequence 5' of the position corresponding to position 12666 of SEQ ID NO: 2, a 3' homology arm that hybridizes to a target sequence 3' of the position corresponding to position 12666 of SEQ ID NO: 2, and a nucleic acid insert comprising a thymine flanked by the 5' homology arm and the 3' homology arm. The exogenous donor sequence can recombine with the HSD17B13 gene in the liver cell, wherein upon recombination of the exogenous donor sequence with the HSD17B13 gene, the thymine is inserted between nucleotides corresponding to positions 12665 and 12666 of SEQ ID NO: 1 when the HSD17B13 gene is optimally aligned with SEQ ID NO: 1. Examples of exogenous donor sequences that can be used in such methods are disclosed elsewhere herein.

Some such methods comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: (a) a nuclease agent (or nucleic acid encoding) that binds to a nuclease target sequence within an HSD17B13 gene, wherein the nuclease target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81. The nuclease agent can cleave and disrupt expression of the HSD17B13 gene in a liver cell in the subject. Some such methods comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: (a) a nuclease agent (or nucleic acid encoding) that binds to a nuclease target sequence within an HSD17B13 gene, wherein the nuclease target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81; and (b) an expression vector comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. The expression vector can be one that does not genomically integrate. Alternatively, a targeting vector (i.e., exogenous donor sequence) can be introduced comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. The nuclease agent can cleave and disrupt expression of the HSD17B13 gene in a liver cell in the subject, and the expression vector can express the recombinant HSD17B13 gene in the liver cell in the subject. Alternatively, the genomically integrated, recombinant HSD17B13 gene can express in the liver cell in the subject. Examples of nuclease agents (e.g., a nuclease-active Cas9 protein and guide RNA) that can be used in such methods are disclosed elsewhere herein. Examples of suitable guide RNAs and guide RNA target sequences are disclosed elsewhere herein. Step (b) can alternatively comprise introducing an expression vector or targeting vector comprising a nucleic acid (e.g., DNA) encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or comprising a sequence that is at least 90%, at least 95%, at least 96%, at least 97%, at least 98%, at least 99%, or 100% identical to HSD17B13 Transcript C, D, F, G, or H or a fragment thereof. Likewise, step (b) can alternatively comprise introducing an mRNA encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or having a complementary DNA (or a portion thereof) that is at least 90%, at least 95%, at least 96%, at least 97%, at least 98%, at least 99%, or 100% identical to HSD17B13 Transcript C, D, F, G, or H or a fragment thereof. Likewise, step (b) can alternatively comprise introducing a protein comprising a sequence that is at least 90%, at least 95%, at least 96%, at least 97%, at least 98%, at least 99%, or 100% identical to HSD17B13 Isoform C, D, F, G, or H or a fragment thereof. In specific methods, the transcript can be HSD17B13 Transcript D (e.g., SEQ ID NO: 7), or the isoform can be HSD17B13 Isoform D (e.g., SEQ ID NO: 15). In other specific methods, a combination of HSD17B13 Isoforms, or expression vectors or targeting vectors encoding a combination of HSD17B13 Isoforms, or mRNAs encoding a combination of HSD17B13 Isoforms can be introduced (e.g., D, DC, DF, DG, DH, DCF, DCG, DCH, DFG, DFH, DGH, DCFG, DCFH, DCGH, DFGH, or DCFGH).

In some such methods, a second nuclease agent is also introduced into the subject or into the liver cell in the subject, wherein the second nuclease agent binds to a second nuclease target sequence within the HSD17B13 gene, wherein the second nuclease target sequence comprises the stop codon for the HSD17B13 gene or is within about 10, 20, 30, 40, 50, 100, 200, 300, 400, 500, or 1,000 nucleotides of the stop codon or is selected from SEQ ID NOS: 82-225, wherein the nuclease agent cleaves the HSD17B13 gene in the liver cell within both the first nuclease target sequence and the second nuclease target sequence, wherein the liver cell is modified to comprise a deletion between the first nuclease target sequence and the second nuclease target sequence. For example, the second nuclease agent can be a Cas9 protein and a guide RNA. Suitable guide RNAs and guide RNA target sequences in proximity to the stop codon are disclosed elsewhere herein.

Such methods can also comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: (a) a DNA-binding protein (or nucleic acid encoding) that binds to a DNA-binding protein target sequence within an HSD17B13 gene, wherein the DNA-binding protein target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81. The DNA-binding protein can alter (e.g., reduce) expression of the HSD17B13 gene in a liver cell in the subject. Such methods can also comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: (a) a DNA-binding protein (or nucleic acid encoding) that binds to a DNA-binding protein target sequence within an HSD17B13 gene, wherein the DNA-binding protein target sequence comprises the start codon for the HSD17B13 gene or is within about 10, 20, 30, 40, 50, 100, 200, 300, 400, 500, or 1,000 nucleotides of the start codon or is selected from SEQ ID NOS: 20-81; and (b) an expression vector comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. The expression vector can be one that does not genomically integrate. Alternatively, a targeting vector (i.e., exogenous donor sequence) can be introduced comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. The DNA-binding protein can alter (e.g., reduce) expression of the HSD17B13 gene in a liver cell in the subject, and the expression vector can express the recombinant HSD17B13 gene in the liver cell in the subject. Alternatively, the genomically integrated, recombinant HSD17B13 gene can express in the liver cell in the subject. Examples of DNA-binding proteins suitable for use in such methods are disclosed elsewhere herein. Such DNA-binding proteins (e.g., Cas9 protein and guide RNA) can be fused or operably linked to a transcriptional repressor domain. For example, the DNA-binding protein can be a catalytically inactive Cas9 protein fused to a transcriptional repressor domain. Such a DNA-binding protein fused to a transcriptional repressor domain can be used, for example, to decrease expression of a wild type HSD17B13 gene or an HSD17B13 gene that is not the rs72613567 variant (e.g., to decrease expression of HSD17B13 Transcript or Isoform A). Examples of suitable guide RNAs and guide RNA target sequences are disclosed elsewhere herein. Step (b) can alternatively comprise introducing an expression vector or targeting vector comprising a nucleic acid (e.g., DNA) encoding an HSD171313 protein that is at least 90%, at least 95%, at least 96%, at least 97%, at least 98%, at least 99%, or 100% identical to HSD17B13 Isoform C, D, F, G, or H or a fragment thereof and/or comprising a sequence that is at least 90%, at least 95%, at least 96%, at least 97%, at least 98%, at least 99%, or 100% identical to HSD17B13 Transcript C, D, F, G, or H or a fragment thereof. Likewise, step (b) can alternatively comprise introducing an mRNA encoding an HSD17B13 protein that is at least 90%, at least 95%, at least 96%, at least 97%, at least 98%, at least 99%, or 100% identical to HSD1 7B 13 Isoform C, D, F, G, or H or a fragment thereof and/or having a complementary DNA (or a portion thereof) that is at least 90%, at least 95%, at least 96%, at least 97%, at least 98%, at least 99%, or 100% identical to HSD17B13 Transcript C, D, F, G, or H or a fragment thereof. Likewise, step (b) can alternatively comprise introducing a protein comprising a sequence that is at least 90%, at least 95%, at least 96%, at least 97%, at least 98%, at least 99%, or 100% identical to HSD17B13 Isoform C, D, F, G, or H or a fragment thereof. In specific methods, the transcript can be HSD17B13 Transcript D (e.g., SEQ ID NO: 7), or the isoform can be HSD17B13 Isoform D (e.g., SEQ ID NO: 15). In other specific methods, a combination of HSD17B13 Isoforms, or expression vectors or targeting vectors encoding a combination of HSD17B13 Isoforms, or mRNAs encoding a combination of HSD17B13 Isoforms can be introduced (e.g., D, DC, DF, DG, DH, DCF, DCG, DCH, DFG, DFH, DGH, DCFG, DCFH, DCGH, DFGH, or DCFGH).

Such methods can also comprise a method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject: an antisense RNA, an siRNA, or an shRNA that hybridizes to a sequence within a region of one or more of HSD17B13 Transcripts A, B, E, and F' (and particularly A) that optionally is not present in one or more HSD17B13 Transcripts C, D, F, G, and H (and particularly D). Optionally, the antisense RNA, siRNA, or shRNA hybridizes to a sequence within SEQ ID NO: 4 (HSD17B13 Transcript A), and the antisense RNA, siRNA, or shRNA can decrease expression of HSD17B13 Transcript A in a cell. Optionally, the antisense RNA, siRNA, or shRNA hybridizes to a sequence present in SEQ ID NO: 4 (HSD17B13 Transcript A) that is not present in SEQ ID NO: 7 (HSD17B13 Transcript D). Optionally, the antisense RNA, siRNA, or shRNA hybridizes to a sequence within exon 7 or a sequence spanning the exon 6-exon 7 boundary of SEQ ID NO: 4 (HSD17B13 Transcript A). For example, the anti sense RNA, siRNA, or shRNA can hybridize to sequence within a region in exon 7 or a region spanning the exon 6-exon 7 boundary of SEQ ID NO: 4 (HSD17B13 Transcript A) and decrease expression of HSD17B13 Transcript A in a liver cell in the subject. Optionally, such methods can further comprise introducing into the subject an expression vector comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. The expression vector can be one that does not genomically integrate. Alternatively, a targeting vector (i.e., exogenous donor sequence) can be introduced comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. In methods in which an expression vector is used, the expression vector can express the recombinant HSD17B13 gene in the liver cell in the subject. Alternatively, in methods in which a recombinant HSD17B13 gene is genomically integrated, the recombinant HSD17B13 gene can express in the liver cell in the subject. Such methods can alternatively comprise introducing an expression vector or targeting vector comprising a nucleic acid (e.g., DNA) encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or comprising a sequence that is at least 90%, at least 95%, at least 96%, at least 97%, at least 98%, at least 99%, or 100% identical to HSD17B13 Transcript C, D, F, G, or H or a fragment thereof. Likewise, such methods can alternatively comprise introducing an mRNA encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or having a complementary DNA (or a portion thereof)

that is at least 90%, at least 95%, at least 96%, at least 97%, at least 98%, at least 99%, or 100% identical to HSD17B13 Transcript C, D, F, G, or H or a fragment thereof. Likewise, such methods can alternatively comprise introducing a protein comprising a sequence that is at least 90%, at least 95%, at least 96%, at least 97%, at least 98%, at least 99%, or 100% identical to HSD17B13 isoform C, D, F, G, or H or a fragment thereof. In specific methods, the transcript can be HSD17B13 Transcript D (e.g., SEQ ID NO: 7), or the isoform can be HSD17B13 Isoform D (e.g., SEQ ID NO: 15). In other specific methods, a combination of HSD17B13 Isoforms, or expression vectors or targeting vectors encoding a combination of HSD17B13 Isoforms, or mRNAs encoding a combination of HSD17B13 Isoforms can be introduced (e.g., D, DC, DF, DG, DH, DCF, DCG, DCH, DFG, DFH, DGH, DCFG, DCFH, DCGH, DFGH, or DCFGH).

Other such methods can comprise method of treating a subject who is not a carrier of the HSD17B13 rs72613567 variant (or is only a heterozygous carrier of the HSD17B13 rs72613567 variant) and has or is susceptible to developing a chronic liver disease, comprising introducing into the subject or introducing into a liver cell in the subject an expression vector, wherein the expression vector comprises a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1, wherein the expression vector expresses the recombinant HSD17B13 gene in a liver cell in the subject. The expression vector can be one that does not genomically integrate. Alternatively, a targeting vector (i.e., exogenous donor sequence) can be introduced comprising a recombinant HSD17B13 gene comprising a thymine inserted between nucleotides corresponding to positions 12665 and 12666 of SEQ ID NO: 1 when the recombinant HSD17B13 gene is optimally aligned with SEQ ID NO: 1. In methods in which an expression vector is used, the expression vector can express the recombinant HSD17B13 gene in the liver cell in the subject. Alternatively, in methods in which a recombinant HSD17B13 gene is genomically integrated, the recombinant HSD17B13 gene can express in the liver cell in the subject. Such methods can alternatively comprise introducing an expression vector or targeting vector comprising a nucleic acid (e.g., DNA) encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or comprising a sequence that is at least 90%, at least 95%, at least 96%, at least 97%, at least 98%, at least 99%, or 100% identical to HSD17B13 Transcript C, D, F, G, or H or a fragment thereof. Likewise, such methods can alternatively comprise introducing an mRNA encoding an HSD17B13 protein that is at least 90%, at least 95%, at least 96%, at least 97%, at least 98%, at least 99%, or 100% identical to HSD17B13 Isoform C, D, F, G, or H or a fragment thereof and/or having a complementary DNA (or a portion thereof) that is at least 90%, at least 95%, at least 96%, at least 97%, at least 98%, at least 99%, or 100% identical to HSD17B13 Transcript C, D, F, G, or H or a fragment thereof. Likewise, such methods can alternatively comprise introducing a protein comprising a sequence that is at least 90%, at least 95%, at least 96%, at least 97%, at least 98%, at least 99%, or 100% identical to HSD17B13 Isoform C, D, F, G, or H or a fragment thereof. In specific methods, the transcript can be HSD1 7B13 Transcript D (e.g., SEQ ID NO: 7), or the isoform can be HSD17B13 Isoform D (e.g., SEQ ID NO: 15). In other specific methods, a combination of HSD17B13 Isoforms, or expression vectors or targeting vectors encoding a combination of HSD17B13 Isoforms, or mRNAs encoding a combination of HSD17B13 Isoforms can be introduced (e.g., D, DC, DF, DG, DH, DCF, DCG, DCH, DFG, DFH, DGH, DCFG, DCFH, DCGH, DFGH, or DCFGH).

Suitable expression vectors and recombinant HSD17B13 genes for use in any of the above methods are disclosed elsewhere herein. For example, the recombinant HSD17B13 gene can be the full rs72613567 variant gene or can be an HSD17B13 minigene in which one or more nonessential segments of the gene have been deleted with respect to a corresponding wild type HSD17B13 gene. As an example, the deleted segments can comprise one or more intronic sequences, and the minigene can comprise an intron corresponding to intron 6 of SEQ ID NO: 2 when optimally aligned with SEQ ID NO: 2. An example of a full rs72613567 variant gene is one that is at least 90%, at least 95%, at least 96%, at least 97%, at least 98%, or at least 99% identical to SEQ ID NO: 2 when optimally aligned with SEQ ID NO: 2.

Some such methods comprise a method of modifying a cell (e.g., a liver cell) in a subject having or susceptible to developing a chronic liver disease. In such methods, the nuclease agents and/or exogenous donor sequences and/or recombinant expression vectors can be introduced into the cell via administration in an effective regime meaning a dosage, route of administration and frequency of administration that delays the onset, reduces the severity, inhibits further deterioration, and/or ameliorates at least one sign or symptom of a chronic liver disease being treated. The term "symptom" refers to a subjective evidence of a disease as perceived by the subject, and a "sign" refers to objective evidence of a disease as observed by a physician. If a subject is already suffering from a disease, the regime can be referred to as a therapeutically effective regime. If the subject is at elevated risk of the disease relative to the general population but is not yet experiencing symptoms, the regime can be referred to as a prophylactically effective regime. In some instances, therapeutic or prophylactic efficacy can be observed in an individual patient relative to historical controls or past experience in the same subject. In other instances, therapeutic or prophylactic efficacy can be demonstrated in a preclinical or clinical trial in a population of treated subjects relative to a control population of untreated subjects.

Delivery can be any suitable method, as disclosed elsewhere herein. For example, the nuclease agents or exogenous donor sequences or recombinant expression vectors can be delivered by vector delivery, viral delivery, particle-mediated delivery, nanoparticle-mediated delivery, liposome-mediated delivery, exosome-mediated delivery, lipid-mediated delivery, lipid-nanoparticle-mediated delivery, cell-penetrating-peptide-mediated delivery, or implantable-device-mediated delivery. Some specific examples include hydrodynamic delivery, virus-mediated delivery, and lipid-nanoparticle-mediated delivery.

Administration can be by any suitable route including, for example, parenteral, intravenous, oral, subcutaneous, intra-arterial, intracranial, intrathecal, intraperitoneal, topical, intranasal, or intramuscular. A specific example which is often used, for example, for protein replacement therapies is intravenous infusion. The frequency of administration and the number of dosages can be depend on the half-life of the nuclease agents or exogenous donor sequences or recombinant expression vectors, the condition of the subject, and the route of administration among other factors. Pharmaceutical compositions for administration are preferably sterile and substantially isotonic and manufactured under GMP conditions. Pharmaceutical compositions can be provided in unit dosage form (i.e., the dosage for a single administration). Pharmaceutical compositions can be formulated using one or more physiologically and pharmaceutically acceptable carriers, diluents, excipients or auxiliaries. The formulation depends on the route of administration chosen. The term "pharmaceutically acceptable" means that the carrier, diluent, excipient, or auxiliary is compatible with the other ingredients of the formulation and not substantially deleterious to the recipient thereof.

Other such methods comprise an ex vivo method in a cell from a subject having or susceptible to developing a chronic liver disease. The cell with the targeted genetic modification can then be transplanted back into the subject.

Any of the therapeutic or prophylactic methods disclosed herein can further comprise administering a therapeutic tailored to prevent or alleviate one or more symptoms associated with progression to more clinically advanced stages of chronic liver disease (e.g., progression from simple steatosis to more clinically advanced stages of chronic liver disease, or progression from simple steatosis to one or more of steatohepatitis, fibrosis, cirrhosis, and hepatocellular carcinoma). For examples, such treatments could be focused on preventing or reducing inflammation or preventing or reducing fibrosis. Examples of such therapeutics in development are provided below.

All patent filings, websites, other publications, accession numbers and the like cited above or below are incorporated by reference in their entirety for all purposes to the same extent as if each individual item were specifically and individually indicated to be so incorporated by reference. If different versions of a sequence are associated with an accession number at different times, the version associated with the accession number at the effective filing date of this application is meant. The effective filing date means the earlier of the actual filing date or filing date of a priority application referring to the accession number if applicable. Likewise, if different versions of a publication, website or the like are published at different times, the version most recently published at the effective filing date of the application is meant unless otherwise indicated. Any feature, step, element, embodiment, or aspect of the invention can be used in combination with any other unless specifically indicated otherwise. Although the present invention has been described in some detail by way of illustration and example for purposes of clarity and understanding, it will be apparent that certain changes and modifications may be practiced within the scope of the appended claims.

BRIEF DESCRIPTION OF THE SEQUENCES

The nucleotide and amino acid sequences listed in the accompanying sequence listing are shown using standard letter abbreviations for nucleotide bases, and three-letter code for amino acids. The nucleotide sequences follow the standard convention of beginning at the 5' end of the sequence and proceeding forward (i.e., from left to right in each line) to the 3' end. Only one strand of each nucleotide sequence is shown, but the complementary strand is understood to be included by any reference to the displayed strand. The amino acid sequences follow the standard convention of beginning at the amino terminus of the sequence and proceeding forward (i.e., from left to right in each line) to the carboxy terminus.

| Drug (Company) | Stage | Type | Gene Target | Notes |
|---|---|---|---|---|
| OCA-Obeticholic acid (Intercept) | Phase III | Agonist | NR1H4 (FXR) | Improved NAS, reversed fibrosis in Phase Iib |
| GS-9674 (Gilead) | Phase I | | | |
| Simtuzumab (Gilead) | Phase II | Inhibitor | LOXL2 | Potential to reverse fibrosis (NASH/PSC) |
| GS-4997 (Gilead) | Phase II | Inhibitor | MAP3K5 | Reduces oxidative stress |
| NDI-010976 (Gilead) | Phase I | Inhibitor | ACACA ACACB | Prevent lipogenesis |
| GFT505/Elafibranor (Genfit) | Phase III | Agonist | PPARA PPARD | Break down fatty acids, block fat & glucose production, dec inflammation |
| Aramchol (Galmed) | Phase II | Inhibitor | SCD (ABCA1) | Fatty acid-bile acid conjugate; boosts liver fat metabolism |
| Cenicriviroc (Tobira) | Phase IIb | Inhibitor | CCR2 CCR5 | Chemokine receptors are involved in inflammation and fibrosis |
| GR-MD-02 (Galectin Therapeutics) | Phase II | Inhibitor | LGALS3 | Galectin-3 is upregulated in fibrosis |
| TD139 (Galecto Biotech) | Phase I | | | |
| SHP626 (Shire) | Phase I | Inhibitor | SLC10A2 | Interferes with bile acid recycling |
| PXS4728A-(Boehringer Ingelheim) | Phase I | Inhibitor | AOC3 | Anti-inflammatory |
| RP103-Cysteamine bitartrate (Raptor) | Phase II | Depleting agent | CTNS | Cysteine-depleting; potential anti-oxidant |

| SEQ ID NO | Type | Description |
|---|---|---|
| 1 | DNA | HSD17B13 Wild Type Genomic Sequence (Human Genome Assembly GRCh38)<br>Transcripts More Prevalent in Subjects with Wild Type HSD17B13 Gene:<br>Transcript A<br><br>Exon 1 = 1-275<br>Exon 2 = 4471-4578<br>Exon 3 = 5684-5815<br>Exon 4 = 7308-7414<br>Exon 5 = 8947-9084<br>Exon 6v1 = 12548-12664<br>Exon 7 = 17599-19118<br>Transcript B<br><br>Exon 1 = 1-275<br>Exon 2 = skipped<br>Exon 3 = 5684-5815<br>Exon 4 = 7308-7414<br>Exon 5 = 8947-9084<br>Exon 6v1 = 12548-12664<br>Exon 7 = 17599-19118<br>Transcript E<br><br>Exon 1 = 1-275<br>Exon 2 = 4471-4578<br>Exon 3 = 5684-5815<br>Exon 3' = 6210-6281<br>Exon 4 = 7308-7414<br>Exon 5 = 8947-9084<br>Exon 6v1 = 12548-12664<br>Exon 7 = 17599-19118<br>Transcript F'<br><br>Exon 1 = 1-275<br>Exon 2 = 4471-4578<br>Exon 3 = 5684-5815<br>Exon 4 = 7308-7414<br>Exon 5 = 8947-9084<br>Exon6v3 = 12548-13501 (Read-through from exon 6 into intron 6 = 12665-13501)<br>Exon 7 = skipped |
| 2 | DNA | HSD17B13 Genomic Sequence Variant (Human Genome Assembly GRCh38; rs72613567-insertion of T at chr4: 87310241-87310240): Insertion of T at position 12666<br>Transcripts More Prevalent in Subjects with rs72613567HSD17B13 Gene Variant:<br>Transcript C<br><br>Exon 1 = 1-275<br>Exon 2 = 4471-4578<br>Exon 3 = 5684-5815<br>Exon 4 = 7308-7414<br>Exon 5 = 8947-9084<br>Exon 6 = skipped<br>Exon 7 = 17600-19119<br>Transcript D<br><br>Exon 1 = 1-275<br>Exon 2 = 4471-4578<br>Exon 3 = 5684-5815<br>Exon 4 = 7308-7414<br>Exon 5 = 8947-9084<br>Exon6v2 = 12548-12665 (Includes additional residue 12665 at 3' end)<br>Exon 7 = 17600-19119<br>Transcript F<br><br>Exon 1 = 1-275<br>Exon 2 = 4471-4578<br>Exon 3 = 5684-5815<br>Exon 4 = 7308-7414<br>Exon 5 = 8947-9084<br>Exon 6v3 = 12548-13502 (Read-through from exon 6 into intron 6 = 12665-13502)<br>Exon 7 = skipped<br>Transcript G<br><br>Exon 1 = 1-275<br>Exon 2 = skipped<br>Exon 3 = 5684-5815<br>Exon 4 = 7308-7414 |

-continued

| SEQ ID NO | Type | Description |
|---|---|---|
| | | Exon 5 = 8947-9084<br>Exon6v2 = 12548-12665 (Includes additional residue 12665 at 3' end)<br>Exon 7 = 17600-19119<br>Transcript H |
| | | Exon 1 = 1-275<br>Exon 2 = 4471-4578<br>Exon 3 = 5684-5815<br>Exon 3' = 6210-6281<br>Exon 4 = 7308-7414<br>Exon 5 = 8947-9084<br>Exon6v2 = 12548-12665 (Includes additional residue 12665 at 3' end)<br>Exon 7 = 17600-19119 |
| 3 | DNA | Endogenous HSD17B13 Promoter (−499 to 100 relative to transcription start site (TSS)) |
| 4 | DNA | HSD17B13 Transcript A cDNA |
| 5 | DNA | HSD17B13 Transcript B cDNA |
| 6 | DNA | HSD17B13 Transcript C cDNA |
| 7 | DNA | HSD17B13 Transcript D cDNA |
| 8 | DNA | HSD17B13 Transcript E cDNA |
| 9 | DNA | HSD17B13 Transcript F cDNA |
| 10 | DNA | HSD17B13 Transcript G cDNA |
| 11 | DNA | HSD17B13 Transcript H cDNA |
| 12 | Protein | HSD17B13 Protein Isoform A |
| 13 | Protein | HSD17B13 Protein Isoform B |
| 14 | Protein | HSD17B13 Protein Isoform C |
| 15 | Protein | HSD17B13 Protein Isoform D |
| 16 | Protein | HSD17B13 Protein Isoform E |
| 17 | Protein | HSD17B13 Protein Isoform F |
| 18 | Protein | HSD17B13 Protein Isoform G |
| 19 | Protein | HSD17B13 Protein Isoform H |
| 20-41 | DNA | Human HSD17B13 TSS Guide RNA Target Sequences |
| 42-81 | DNA | Other Human HSD17B13 5' Guide RNA Target Sequences |
| 82-225 | DNA | Human HSD17B13 3' Guide RNA Target Sequences |
| 226-239 | DNA | Human HSD17B13 Guide RNA Target Sequences Near rs72613567 Variation |
| 240 | Protein | Human HSD17B13 Protein Q7Z5P4-1 |
| 241 | Protein | Human HSD17B13 Protein Q7Z5P4-2 |
| 242 | Protein | Human HSD17B13 Protein NP_835236.2 |
| 243 | Protein | Human HSD17B13 Protein NP_001129702.1 |
| 244 | DNA | Human HSD17B13 cDNA NM_178135.4 |
| 245 | DNA | Human HSD17B13 cDNA NM_001136230.2 |
| 246 | DNA | HSD17B13 Transcript F' |
| 247 | Protein | HSD17B13 Protein Isoform F' |
| 248-250 | DNA | Guide RNA Target Sequences Plus PAM |
| 251 | DNA | PST516 Primer |
| 252 | DNA | PST517 Primer |
| 253 | DNA | DE002 Primer |
| 254 | DNA | HSD17B13 Primer 1 |
| 255 | DNA | HSD17B13 Primer 2 |
| 256-258 | RNA | Guide RNA Scaffolds v2-v4 |
| 259-263 | DNA | Mouse 5' Guide RNA Target Sequences |
| 264-268 | DNA | Mouse Exon 6/7 Guide RNA Target Sequences |
| 269 | DNA | Mouse Hsd17b13 Locus |
| 270-489 | RNA | Human HSD17B13 crRNAs |
| 490-499 | RNA | Mouse Hsd17b13 crRNAs |
| 500-719 | RNA | Human HSD17B13 sgRNAs v1 |
| 720-729 | RNA | Mouse Hsd17b13 sgRNAs v1 |
| 730-949 | RNA | Human HSD17B13 sgRNAs v2 |
| 950-959 | RNA | Mouse Hsd17b13 sgRNAs v2 |
| 960-1179 | RNA | Human HSD17B13 sgRNAs v3 |
| 1180-1189 | RNA | Mouse Hsd17b13 sgRNAs v3 |
| 1190-1409 | RNA | Human HSD17B13 sgRNAs v4 |
| 1410-1419 | RNA | Mouse Hsd17b13 sgRNAs v4 |
| 1420 | RNA | Guide RNA Scaffold v1 |
| 1421 | RNA | crRNA tail |
| 1422 | RNA | tracrRNA |
| 1423-1642 | RNA | Human HSD17B13 Guide RNA DNA-Targeting Segments |
| 1643-1652 | RNA | Mouse Hsd17b13 Guide RNA DNA-Targeting Segments |

EXAMPLES

Example 1. Variant 17beta-hydroxysteroid dehydrogenase 13 protects against chronic Liver Disease Chronic liver disease and cirrhosis are leading causes of morbidity and mortality in the U.S. (Kochanek et al. (2016) *Natl Vital Stat Rep* 65:1-122, herein incorporated by reference in its entirety for all purposes). The most common etiologies of cirrhosis are alcoholic liver disease, chronic hepatitis C, and nonalcoholic fatty liver disease (NAFLD), together accounting for ~80% of patients awaiting liver transplant (Wong et al. (2015) *Gastroenterology* 148:547 555, herein incorporated by reference in its entirety for all purposes). Notably, the estimated prevalence of NAFLD in the U.S. is between 19 and 46 percent (Browning et al. (2004) *Hepatology* 40:1387-1395; Lazo et al. (2013) *Am J Epidemiol* 178:38-45; and Williams et al. (2011) *Gastroenterology* 140:124-131, each of which is herein incorporated by reference in its entirety for all purposes) and is rising over time (Younossi et al. (2011) *Clin Gastroenterol Hepatol* 9:524-530 el; quiz e60 (2011), herein incorporated by reference in its entirety for all purposes), likely in conjunction with increased rates of obesity. To date, there remains much uncertainty about the inter-individual variation in NAFLD progression and outcomes; knowledge of underlying genetic factors could improve risk stratification and provide the foundation for novel therapeutic strategies. Here, we show that carriers of a splice variant in HSD17B13 (encoding hydroxysteroid-17-beta dehydrogenase 13) have reduced risk of alcoholic and nonalcoholic liver disease, and reduced risk of NAFLD progression. Association studies of whole exome sequence data linked to electronic health records from 46,544 European ancestry participants in the DiscovEHR study led to the identification of a splice variant in HSD 7B13 (r572613567) associated with reduced alanine transaminase and aspartate transaminase levels; these findings were replicated in three separate cohorts comprising 12,528 individuals. In the discovery cohort, variant HSD17B13 was associated with reduced risk of alcoholic and nonalcoholic liver disease, cirrhosis, and hepatocellular carcinoma. In a bariatric surgery cohort, the variant was associated with reduced risk of histopathological steatohepatitis in individuals with steatosis. RNA sequencing of human liver samples from the bariatric surgery cohort revealed that homozygous carriers of the splice variant predominantly express a novel transcript coding for a truncated HSD17B13 isoform. These findings shed new light on the role of HSD17B13 in promoting liver disease progression, and its potential as a therapeutic target for steatohepatitis and cirrhosis.

Previous genome wide association studies (GWAS) have identified a limited number of genes and variants associated with chronic liver disease. The most robustly validated genetic association to date is to a common missense variant in the patatin-like phospholipase domain containing 3 gene (PNPLA3 p.Ile148Met, rs738409), initially found to be associated with increased risk of nonalcoholic fatty liver disease (NAFLD) (Romeo et al. (2008) *Nat Genet* 40:1461-1465 and Speliotes et al. (2011) *PLoS Genet* 7:e1001324, each of which is herein incorporated by reference in its entirety for all purposes), and subsequently found to be associated with disease severity (Rotman et al. (2010) Hepatology 52:894-903 and Sookoian et al. (2009) *J Lipid Res* 50:2111-2116, each of which is herein incorporated by reference in its entirety for all purposes) and progression (Trepo et al. (2016), *J Hepatol* doi:10.1016/j.jhep.2016.03.011, herein incorporated by reference in its entirety for all purposes). Variation in the transmembrane 6 superfamily member 2 (7M6SF2) gene has also been shown to confer increased risk for NAFLD (Kozlitina et al. (2014) *Nat Genet* 46:352-356, Liu et al. (2014) *Nat Commun* 5:4309, and Sookoian et al. (2015) *Hepatology* 61:515-525, each of which is herein incorporated by reference in its entirety for all purposes). The normal functions of these two proteins are not well understood, though both have been proposed to be involved in hepatocyte lipid metabolism. How variants in PNPLA3 and 7706SF2 contribute to increased risk of liver disease has yet to be elucidated. GWAS have also identified several genetic factors to be associated with serum alanine aminotransferase (ALT) and aspartate aminotransferase (AST) (Chambers et al. (2011) *Nat Genet* 43:1131-1138 and Yuan et al. (2008) *Am J Hum Genet* 83:520-528, each of which is herein incorporated by reference in its entirety for all purposes), quantitative markers of hepatocyte injury and liver fat accumulation that are frequently measured clinically. To date, there are no described protective genetic variants for chronic liver disease. The discovery of protective genetic variants in other settings, such as loss-of-function variants in PCSK9 that reduce the risk of cardiovascular disease, has been the catalyst for development of new classes of therapeutics.

The DiscovEHR collaboration between the Regeneron Genetics Center and the Geisinger Health System (GHS) couples exome sequencing to de-identified electronic health record (EHR) data to enable genetic discoveries and precision medicine (Dewey et al. (2016) Science 354(6319) doi:10.1126/science.aaf6814, herein incorporated by reference in its entirety for all purposes). The DiscovEHR cohort is comprised of patients recruited from primary and specialty medical care cohorts across the GHS integrated healthcare system, including bariatric surgery patients with liver biopsy specimens (Gorden et al. (2013) *Hum Hered* 75:34-43, herein incorporated by reference in its entirety for all purposes). In this study, we undertook a comprehensive functional genomics approach to assess the contribution of exome sequence variation to quantitative traits, disease diagnoses, and histopathologic phenotypes relevant to chronic liver disease and cirrhosis in 49,188 individuals of European descent from the DiscovEHR cohort, with follow-up studies using whole exome sequencing of 9,883 individuals of European ancestry.

Using whole exome sequence data linked to EHR-derived phenotypes, we first carried out an association study of serum ALT and AST measures in 46,544 individuals of European descent from the DiscovEHR cohort ("GHS discovery cohort"). Clinical characteristics of the cohort are described in Table 1A. There were 41,908 individuals with ERR-documented transaminase measures (including 40,561 individuals with both ALT and AST measures). We used a linear mixed model (Yang et al. (2011) *Am J Hum Genet* 88:76-82, herein incorporated by reference in its entirety for all purposes) to detect associations between $\log_{10}$-transformed median ALT and AST levels (adjusted for sex, age, $age^2$, body mass index (BMI) and the first four principle components of ancestry) and 502,219 biallelic single variants with minor allele frequency greater than 0.1%. Using an exome-wide significance threshold of $P<1.0\times10^7$, we identified 35 variants in 19 genes significantly associated with ALT or AST, including eight variants in seven genes that were associated with both ALT and AST (FIG. 1 and Table 2).

TABLE 1A

Demographics and clinical characteristics of sequenced European-ancestry individuals from the discovery and replication cohorts.

| Characteristic | Discovery Cohort (N = 46,544) | Bariatric Surgery Cohort (N = 2,644) | Dallas Heart Study (N = 1,357) | Penn Medicine Biobank (N = 8,526) |
|---|---|---|---|---|
| Age (years)-median (IQR) | 62.9 (49.6-73.8) | 52.9 (44.1-61.2) | 46.0 (38.0-54.0) | 68.0 (60.0-76.0) |
| Female sex-number (%) | 26,875 (57.7) | 2,119 (80.1) | 724 (53.4) | 3,242 (38.0) |
| Body mass index-median (IQR) | 29.9 (35.4-44.8) | 47.4 (42.0-53.7) | 28 (25-32) | 30 (25-32) |
| Transaminase level (U/L)-median (IQR) | | | | |
| Alanine aminotransferase (ALT) | 22.0 (17.0-29.0) | 23.0 (17.5-29.5) | 20.0 (15.0-27.0) | 22.0 (17.0-30.0) |
| Aspartate aminotransferase (AST) | 23.0 (20.0-27.5) | 23.0 (20.0-27.0) | 21.0 (18.0-25.0) | 24.0 (20.0-30.5) |
| Presence of liver disease (by ICD-9 code)-N (%) | | | | |
| Alcoholic liver disease | 197 (0.4) | 7 (0.3) | — | — |
| Alcoholic cirrhosis | 130 (0.3) | 3 (0.1) | — | — |
| Nonalcoholic, non-viral liver disease | 1,938 (4.2) | 1,543 (58.4) | — | — |
| Nonalcoholic cirrhosis | 382 (0.8) | 24 (0.9) | — | — |
| Hepatocellular carcinoma | 76 (0.2) | 1 (0.04) | — | — |
| No liver disease | 30,628 (65.8) | 1 (0.04) | — | — |

TABLE 1B

Demographics and clinical characteristics of genotyped multi-ethnic cases and controls from the Dallas Liver and Pediatric Liver Studies.

| Characteristic | Dallas Liver Study Cases (N = 517) | Dallas Liver Study Controls (N = 4,279) | Dallas Pediatric Liver Study Cases (N = 203) | Dallas Pediatric Liver Study Controls (N = 244) |
|---|---|---|---|---|
| Age (years)-median (IQR) | 55 (48-60) | 44 (36-53) | 12 (10-15) | 12 (11-14) |
| Female sex-number (%) | 277 (54) | 2,494 (58) | 65 (32) | 126 (52) |
| Body mass index-median (IQR) | 30 (27-35) | 30 (26-35) | 30 (27-34) | 31 (28-35) |
| Self-reported ethnicity | | | | |
| African American | 33 (6) | 2,291 (54) | — | — |
| European American | 158 (31) | 1,266 (30) | — | — |
| Hispanic American | 326 (63) | 722 (17) | 203 (100) | 244 (100) |
| Presence of liver disease (by ICD-9 code)-N (%) | | | | |
| Alcoholic liver disease | 223 (43) | — | — | — |
| Alcoholic cirrhosis | 215 (42) | — | — | — |
| Nonalcoholic, non-viral liver disease | 212 (20) | — | — | — |
| Nonalcoholic cirrhosis | 100 (19) | — | — | — |
| Hepatocellular carcinoma | 44 (9) | — | — | — |
| No liver disease | — | 4,279 (100) | — | –244 (100) |

TABLE 2

Single nucleotide variants associated with serum transaminase levels at $P < 1.0 \times 10^{-7}$ in the discovery cohort.

| Trait | CHR | BP | REF | ALT | rsID | Gene | Annotation | AA Substitution | Beta (SE) | P |
|---|---|---|---|---|---|---|---|---|---|---|
| ALT | 1 | 220970028 | A | G | rs2642438 | MARC1 | missense | p.Thr165Ala | 0.008 (0.001) | 4.67E-08 |
| | 4 | 88231392 | T | TA | *rs72613567 | HSD17B13 | splice donor | | −0.009 (0.001) | 4.16E-12 |
| | 8 | 144997604 | C | T | rs371119003 | PLEC | missense | p.Ala2302Thr | −0.160 (0.026) | 1.30E-09 |

TABLE 2-continued

Single nucleotide variants associated with serum transaminase levels at $P < 1.0 \times 10^{-7}$ in the discovery cohort.

| | | | | | | | | | |
|---|---|---|---|---|---|---|---|---|---|
| 8 | 145008502 | G | A | | PLEC | missense | p.Arg522Cys | −0.268 (0.032) | 3.26E-17 |
| 8 | 145692918 | G | A | rs35968570 | KIFC2 | missense | p.Glu174Lys | −0.033 (0.005) | 1.40E-11 |
| 8 | 145730072 | G | A | rs143408057 | GPT | missense | p.Arg83His | −0.314 (0.036) | 3.28E-18 |
| 8 | 145730161 | C | T | rs201815297 | GPT | missense | p.Ala87Val | −0.224 (0.014) | 6.28E-59 |
| 8 | 145730221 | G | A | rs112574791 | GPT | missense | p.Arg107Lys | −0.033 (0.005) | 4.25E-11 |
| 8 | 145731636 | T | G | rs145155876 | GPT | stop gained | p.Tyr326* | −0.235 (0.031) | 1.76E-14 |
| 8 | 145732114 | G | C | rs141505249 | GPT | missense | p.Glu430Gln | −0.224 (0.013) | 8.84E-64 |
| 8 | 145732151 | G | A | rs143462595 | GPT | missense | p.Arg442His | −0.077 (0.013) | 1.18E-09 |
| 8 | 145732180 | G | C | rs147998249 | GPT | missense | p.Val452Leu | −0.225 (0.013) | 8.19E-65 |
| 8 | 145732305 | G | GC | | GPT | frameshift | p.Glu475fs | −0.271 (0.031) | 1.00E-18 |
| 8 | 145748532 | A | G | rs567402720 | LRRC24 | missense | p.Leu290Ser | −0.185 (0.028) | 3.42E-11 |
| 9 | 117122202 | C | T | rs3748177 | AKNA | synonymous | p.Glu755Glu | −0.007 (0.001) | 9.51E-09 |
| 9 | 117124731 | G | A | rs3748176 | AKNA | missense | p.Pro624Leu | −0.007 (0.001) | 4.31E-09 |
| 10 | 101595996 | T | A | rs17222723 | ABCC2 | missense | p.Val1188Glu | −0.015 (0.003) | 2.97E-08 |
| 10 | 101606861 | G | T | rs1137968 | ABCC2 | synonymous | p.Val1430Val | −0.015 (0.003) | 2.71E-08 |
| 10 | 101610533 | C | T | rs8187707 | ABCC2 | synonymous | p.His1496His | −0.015 (0.003) | 2.77E-08 |
| 10 | 101611294 | G | A | rs8187710 | ABCC2 | missense | p.Cys1515Tyr | −0.015 (0.003) | 2.15E-08 |
| 10 | 101912064 | T | C | *rs2862954 | ERLINI | missense | p.Ile291Val | −0.012 (0.001) | 2.43E-21 |
| 10 | 101977883 | C | T | rs2230804 | CHUK | missense | p.Val268Ile | −0.009 (0.001) | 1.93E-13 |
| 10 | 113917085 | T | A | rs2254537 | GPAM | synonymous | p.Pro681Pro | −0.008 (0.001) | 4.61E-10 |
| 10 | 113940329 | T | C | rs2792751 | GPAM | missense | p.Ile43Val | −0.008 (0.001) | 2.54E-10 |
| 14 | 94844947 | C | T | *rs28929474 | SERPINA1 | missense | p.Glu366Lys | 0.042 (0.005) | 9.28E-21 |
| 19 | 19379549 | C | T | *rs58542926 | TM6SF2 | missense | p.Glu167Lys | 0.014 (0.002) | 4.76E-09 |
| 22 | 44324727 | c | G | *rs738409 | BNBLA3 | missense | p.Ile148Met | 0.023 (0.002) | 1.34E-50 |
| 22 | 44324730 | C | T | *rs738408 | FNFLA3 | synonymous | p.Pro149Pro | 0.023 (0.002) | 1.11E-50 |
| 22 | 44342116 | A | G | rs2294918 | FNFLA3 | missense | p.Lys434Glu | 0.007 (0.001) | 8.26E-08 |

TABLE 2-continued

Single nucleotide variants associated with serum transaminase levels at $P < 1.0 \times 10^{-7}$ in the discovery cohort.

| | | | | | | | | | | |
|---|---|---|---|---|---|---|---|---|---|---|
| | 22 | 44368122 | A | G | *rs3761472 | SAMM50 | missense | p.Asp110Gly | 0.019 (0.002) | 8.85E-30 |
| | 22 | 44395451 | T | C | *rs1007863 | PARVB | missense | p.Trp37Arg | 0.011 (0.001) | 7.98E-16 |
| AST | 4 | 88231392 | T | TA | *rs72613567 | HSD17B13 | splice donor | | −0.005 (0.001) | 6.24E-10 |
| | 10 | 18242311 | A | G | rs10764176 | SLC39A12 | missense | p.Ser36Gly | −0.006 (0.001) | 1.09E-10 |
| | 10 | 101157378 | CG TT | C | | GOT1 | inframe indel | p.Asn389del | −0.221 (0.024) | 1.96E-20 |
| | 10 | 101165533 | G | C | rs374966349 | GOT1 | missense | p.Gln208Glu | 0.271 (0.027) | 2.43E-24 |
| | 10 | 101912064 | T | C | *rs2862954 | ERLINI | missense | p.Ile291Val | −0.005 (0.001) | 4.82E-09 |
| | 11 | 22271870 | A | T | rs7481951 | ANO5 | missense | p.Leu322Phe | 0.004 (0.001) | 9.61E-08 |
| | 14 | 94844947 | C | T | *rs28929474 | SERPINA1 | missense | p.Glu366Lvs | 0.027 (0.003) | 2.44E-20 |
| | 19 | 19379549 | C | T | *rs58542926 | TM6SF2 | missense | p.Glu167Lvs | 0.008 (0.002) | 6.54E-08 |
| | 22 | 44324727 | C | G | *rs738409 | PNPLA3 | missense | p.Ile148Met | 0.014 (0.001) | 8.31E-46 |
| | 22 | 44324730 | C | T | *rs738408 | PNPLA3 | synonymous | p.Pro149Pro | 0.014 (0.001) | 8.93E-46 |
| | 22 | 44368122 | A | G | *rs3761472 | SAMM50 | missense | p.Asp110Gly | 0.011 (0.001) | 1.22E-22 |
| | 22 | 44395451 | T | C | *rs1007863 | PARVB | missense | p.Trp37Arg | 0.006 (0.001) | 1.31E-13 |

| | | | | N | | | Mean AST or ALT level (U/L) | | |
|---|---|---|---|---|---|---|---|---|---|
| Trait | CHR | AAF | N | REF/REF | REF/ALT | ALT/ALT | REF/REF | REF/ALT | ALT/ALT |
| ALT | 1 | 0.7067 | 41,414 | 3,515 | 17,262 | 20,637 | 23.88 | 24.52 | 24.92 |
| | 4 | 0.2634 | 41,414 | 22,441 | 16,130 | 2,843 | 25.02 | 24.26 | 24.1 |
| | 8 | 0.0005 | 41,413 | 41,373 | 40 | 0 | 24.67 | 18.1 | NA |
| | 8 | 0.0003 | 41,414 | 41,387 | 27 | 0 | 24.67 | 13.8 | NA |
| | 8 | 0.0139 | 41,414 | 40,271 | 1,133 | 10 | 24.67 | 12.07 | NA |
| | 8 | 0.0003 | 41,414 | 41,393 | 21 | 0 | 24.67 | 12.07 | NA |
| | 8 | 0.0018 | 41,414 | 41,270 | 144 | 0 | 24.7 | 14.68 | NA |
| | 8 | 0.0136 | 41,414 | 40,293 | 1,111 | 10 | 24.71 | 23.09 | 18.35 |
| | 8 | 0.0004 | 41,394 | 41,364 | 30 | 0 | 24.67 | 14.07 | NA |
| | 8 | 0.0019 | 41,375 | 41,223 | 150 | 2 | 24.7 | 14.48 | 13.75 |
| | 8 | 0.0021 | 41,406 | 41,232 | 174 | 0 | 24.68 | 20.87 | NA |
| | 8 | 0.0019 | 41,413 | 41,254 | 159 | 0 | 24.7 | 14.74 | NA |
| | 8 | 0.0004 | 41,414 | 41,385 | 29 | 0 | 24.67 | 14.24 | NA |
| | 8 | 0.0004 | 41,393 | 41,358 | 35 | 0 | 24.67 | 17.71 | NA |

TABLE 2-continued

Single nucleotide variants associated with serum transaminase levels at $P < 1.0 \times 10^{-7}$ in the discovery cohort.

| | | | | | | | | | |
|---|---|---|---|---|---|---|---|---|---|
| | 9 | 0.5232 | 41,414 | 9,414 | 20,645 | 11,355 | 25.12 | 24.72 | 24.18 |
| | 9 | 0.5230 | 41,412 | 9,427 | 20,634 | 11,351 | 25.12 | 24.73 | 24.17 |
| | 10 | 0.0608 | 41,414 | 36,543 | 4,704 | 167 | 24.77 | 23.97 | 22.12 |
| | 10 | 0.0608 | 41,414 | 36,543 | 4,704 | 167 | 24.77 | 23.97 | 22.04 |
| | 10 | 0.0608 | 41,414 | 36,542 | 4,706 | 166 | 24.77 | 23.97 | 22.03 |
| | 10 | 0.0611 | 41,414 | 36,519 | 4,726 | 169 | 24.77 | 23.97 | 21.99 |
| | 10 | 0.4755 | 41,414 | 11,318 | 20,819 | 9,277 | 25.32 | 24.71 | 23.77 |
| | 10 | 0.5072 | 41,414 | 10,048 | 20,733 | 10,633 | 25.18 | 24.75 | 24.01 |
| | 10 | 0.7073 | 41,414 | 3,627 | 16,984 | 20,803 | 25 | 24.97 | 24.36 |
| | 10 | 0.7097 | 41,412 | 3,567 | 16,910 | 20,935 | 25 | 24.98 | 24.35 |
| | 14 | 0.0171 | 41,414 | 40,006 | 1,399 | 9 | 24.58 | 26.91 | 43.89 |
| | 19 | 0.0759 | 41,413 | 35,388 | 5,780 | 245 | 24.52 | 25.46 | 26.84 |
| | 22 | 0.2351 | 41,414 | 24,257 | 14,837 | 2,320 | 24.06 | 24.99 | 28.91 |
| | 22 | 0.2349 | 41,414 | 24,273 | 14,824 | 2,317 | 24.06 | 24.98 | 28.92 |
| | 22 | 0.5986 | 41,412 | 6,691 | 19,833 | 14,888 | 24.15 | 24.47 | 25.15 |
| | 22 | 0.1682 | 41,413 | 28,626 | 11,618 | 1,169 | 24.23 | 25.36 | 28.45 |
| | 22 | 0.3963 | 41,414 | 15,036 | 19,920 | 6,458 | 24.15 | 24.6 | 26.09 |
| AST | 4 | 0.2638 | 40,753 | 22,068 | 15,870 | 2,815 | 24.47 | 24.1 | 23.96 |
| | 10 | 0.2881 | 40,753 | 20,645 | 16,738 | 3,370 | 24.47 | 24.15 | 23.85 |
| | 10 | 0.0002 | 40,753 | 40,733 | 20 | 0 | 24.29 | 14.7 | NA |
| | 10 | 0.0002 | 40,753 | 40,736 | 17 | 0 | 24.28 | 44.5 | NA |
| | 10 | 0.4754 | 40,753 | 11,138 | 20,486 | 9,129 | 24.59 | 24.26 | 23.99 |
| | 11 | 0.5833 | 40,722 | 7,123 | 19,686 | 13,913 | 24.03 | 24.22 | 24.53 |
| | 14 | 0.0172 | 40,753 | 39,361 | 1,384 | 8 | 24.24 | 25.76 | 34.5 |
| | 19 | 0.0760 | 40,752 | 34,811 | 5,698 | 243 | 24.21 | 24.74 | 25.43 |
| | 22 | 0.2343 | 40,753 | 23,889 | 14,622 | 2,242 | 23.96 | 24.48 | 26.62 |
| | 22 | 0.2341 | 40,753 | 23,905 | 14,609 | 2,239 | 23.96 | 24.47 | 26.63 |
| | 22 | 0.1680 | 40,752 | 28,170 | 11,450 | 1,132 | 24.07 | 24.64 | 26.24 |
| | 22 | 0.3961 | 40,753 | 14,761 | 19,678 | 6,314 | 24.02 | 24.23 | 25.1 |

*Indicates variants having exome-wide significant associations with both ALT and AST.
Abbreviations:
AAF, alternate allele frequency;
Alt, alternate allele;
ALT, alanine aminotransferase;
AST, aspartate aminotransferase;
Ref, reference allele;
SE, standard error.

To replicate these associations, we analyzed the 35 AST- or ALT-associated variants ascertained via whole exome sequencing in three separate European-ancestry cohorts: 2,644 bariatric surgery patients from DiscovEHR ("GHS bariatric surgery cohort"), 1,357 individuals from the Dallas Heart Study, and 8,526 individuals from the Penn Medicine Biobank (Table 1A). In meta-analysis of the replication cohorts, thirteen variants in nine genes were significantly associated (Bonferroni significance threshold of $P<1.43\times10^{-3}$) with ALT or AST (Table 3). These included previously reported liver disease-associated genes and variants, such as PNPLA3 p.Ile148Met (Romeo et al. (2008) *Nat Genet* 40:1461-1465, herein incorporated by reference in its entirety for all purposes), 7M6SF2 p.Glu167Lys (Kozlitina et al. (2014) *Nat Genet* 46:352-356, herein incorporated by reference in its entirety for all purposes), and SERPINA1 p.Glu366Lys (Z allele associated with alpha-1-anti-trypsin deficiency) (Brandy et al. (1988) *Am J Med* 84:13-31, herein incorporated by reference in its entirety for all purposes), SAMM50, and ERLIN1. SERPINA1 encodes alpha-1-anti-trypsin, whose functional deficiency is known to cause hereditary liver disease; the association with SAMM50 may be mediated via linkage disequilibrium with variation in PNPLA3, and ERLIN/has been implicated in liver fat deposition. Several variants in GPT and GOT1, the genes encoding ALT and AST, respectively, were significantly associated with either ALT or AST levels but have not been previously reported to be associated with liver disease. SLC39A12 has not previously been linked to transaminases or liver disease. Meta-analysis also replicated novel associations in our discovery cohort between decreased levels of ALT (beta (SE) −0.009 (0.001); P=$4.16\times10^{-12}$) and AST (beta (SE) −0.005 (0.001); P=$6.24\times10^{10}$) and a splice variant in HSD17B13, the gene encoding hydroxysteroid 17-beta dehydrogenase 13, an uncharacterized member of the 17-beta hydroxysteroid dehydrogenase family. This variant, rs72613567, corresponds to the insertion of an A nucleotide adjacent to the donor splice site (TA allele). Replication meta-analysis P-values for these associations were $3.85\times10^{5}$ and $9.38\times10^{5}$, and joint meta-analysis P-values were $1.17\times10^{-15}$ and $6.82\times10^{-13}$ for ALT and AST, respectively (Table 3). A prior GWAS identified a nearby locus at 4q22 (rs6834314) as being associated with ALT levels (Chambers et al. (2011) *Nat Genet* 43:1131-1138, herein incorporated by reference in its entirety for all purposes); to our knowledge, there are no previous studies describing any association with rs72613567.

TABLE 3

Replication and joint meta-analysis of 35 exome-wide significant single nucleotide variants from the discovery cohort in three separate European-ancestry cohorts.

| | | | | | | | | | GHS Discovery Cohort | |
|---|---|---|---|---|---|---|---|---|---|---|
| Trait | Chr | BP | Ref | Alt | RSID | Gene | Ann | AA Substitution | Beta (SE) | P |
| ALT | 1 | 220970028 | A | G | rs2642438 | MARC1 | mis | p.Thr165Ala | 0.008 (0.001) | 4.67E−08 |
| | 4 | 88231392 | T | TA | rs72613567 | HSD17B13 | spl | | −0.009 (0.001) | 4.16E−12 |
| | 8 | 144997604 | C | T | rs371119003 | PLEC | mis | p.Ala2302Thr | −0.160 (0.026) | 1.30E−09 |
| | 8 | 145008502 | G | A | | PLEC | mis | p.Arg522Cys | −0.268 (0.032) | 3.26E−17 |
| | 8 | 145692918 | G | A | rs35968570 | KIFC2 | mis | p.Glu174Lys | −0.033 (0.005) | 1.40E−11 |
| | 8 | 145730072 | G | A | rs143408057 | GPT | mis | p.Arg83His | −0.314 (0.036) | 3.28E−18 |
| | 8 | 145730161 | C | T | rs201815297 | GPT | mis | p.Ala87Val | −0.224 (0.014) | 6.28E−59 |
| | 8 | 145730221 | G | A | rs112574791 | GPT | mis | p.Arg107Lys | −0.033 (0.005) | 4.25E−11 |
| | 8 | 145731636 | T | G | rs145155876 | GPT | stop | p.Tyr326* | −0.235 (0.031) | 1.76E−14 |
| | 8 | 145732114 | G | C | rs141505249 | GPT | mis | p.Glu430Gln | −0.224 (0.013) | 8.84E−64 |
| | 8 | 145732151 | G | A | rs143462595 | GPT | mis | p.Arg442His | −0.077 (0.013) | 1.18E−09 |
| | 8 | 145732180 | G | C | rs147998249 | GPT | mis | p.Val452Leu | −0.225 (0.013) | 8.19E−65 |
| | 8 | 145732305 | G | GC | | GPT | fs | p.Glu475fs | −0.271 (0.031) | 1.00E−18 |
| | 8 | 145748532 | A | G | rs567402720 | LRRC24 | mis | p.Leu290Ser | −0.185 (0.028) | 3.42E−11 |
| | 9 | 117122202 | C | T | rs3748177 | AKNA | syn | p.Glu755Glu | −0.007 (0.001) | 9.51E−09 |
| | 9 | 117124731 | G | A | rs3748176 | AKNA | mis | p.Pro624Leu | −0.007 (0.001) | 4.31E−09 |
| | 10 | 101595996 | T | A | rs17222723 | ABCC2 | mis | p.Val1188Glu | −0.015 (0.003) | 2.97E−08 |
| | 10 | 101606861 | G | T | rs1137968 | ABCC2 | syn | p.Val1430Val | −0.015 (0.003) | 2.71E−08 |
| | 10 | 101610533 | C | T | rs8187707 | ABCC2 | syn | p.His1496His | −0.015 (0.003) | 2.77E−08 |
| | 10 | 101611294 | G | A | rs8187710 | ABCC2 | mis | p.Cys1515Tyr | −0.015 (0.003) | 2.15E−08 |
| | 10 | 101912064 | T | C | rs2862954 | ERLIN1 | mis | p.Ile291Val | −0.012 (0.001) | 2.43E−21 |
| | 10 | 101977883 | C | T | rs2230804 | CHUK | mis | p.Val268Ile | −0.009 (0.001) | 1.93E−13 |
| | 10 | 113917085 | T | A | rs2254537 | GPAM | syn | p.Pro681Pro | −0.008 (0.001) | 4.61E−10 |
| | 10 | 113940329 | T | C | rs2792751 | GPAM | mis | p.Ile43Val | −0.008 (0.001) | 2.54E−10 |

TABLE 3-continued

Replication and joint meta-analysis of 35 exome-wide significant single nucleotide variants from the discovery cohort in three separate European-ancestry cohorts.

| | | | | | | | | | | |
|---|---|---|---|---|---|---|---|---|---|---|
| | 14 | 94844947 | C | T | rs28929474 | SERPINA1 | mis | p.Glu366Lys | 0.042 (0.005) | 9.28E−21 |
| | 19 | 19379549 | C | T | rs58542926 | TM6SF2 | mis | p.Glu167Lys | 0.014 (0.002) | 4.76E−09 |
| | 22 | 44324727 | C | G | rs738409 | PNPLA3 | mis | p.Ile148Met | 0.023 (0.002) | 1.34E−50 |
| | 22 | 44324730 | C | T | rs738408 | PNPLA3 | syn | p.Pro149Pro | 0.023 (0.002) | 1.11E−50 |
| | 22 | 44342116 | A | G | rs2294918 | PNPLA3 | mis | p.Lys434Glu | 0.007 (0.001) | 8.26E−08 |
| | 22 | 44368122 | A | G | rs3761472 | SAMM50 | mis | p.Asp110Gly | 0.019 (0.002) | 8.85E−30 |
| | 22 | 44395451 | T | C | rs1007863 | PARVB | mis | p.Trp37Arg | 0.011 (0.001) | 7.98E−16 |
| AST | 4 | 88231392 | T | TA | rs72613567 | HSD17B13 | spl | | −0.005 (0.001) | 6.24E−10 |
| | 10 | 18242311 | A | G | rs10764176 | SLC39A12 | mis | p.Ser36Gly | −0.006 (0.001) | 1.09E−10 |
| | 10 | 101157378 | CGTT | C | | GOT1 | inf | p.Asn389del | −0.221 (0.024) | 1.96E−20 |
| | 10 | 101165533 | G | C | rs374966349 | GOT1 | mis | p.Gln208Glu | 0.271 (0.027) | 2.43E−24 |
| | 10 | 101912064 | T | C | rs2862954 | ERLIN1 | mis | p.Ile291Val | −0.005 (0.001) | 4.82E−09 |
| | 11 | 22271870 | A | T | rs7481951 | ANO5 | mis | p.Leu322Phe | 0.004 (0.001) | 9.61E−08 |
| | 14 | 94844947 | C | T | rs28929474 | SERPINA1 | mis | p.Glu366Lys | 0.027 (0.003) | 2.44E−20 |
| | 19 | 19379549 | C | T | rs58542926 | TM6SF2 | mis | p.Glu167Lys | 0.008 (0.002) | 6.54E−08 |
| | 22 | 44324727 | C | G | rs738409 | PNPLA3 | mis | p.Ile148Met | 0.014 (0.001) | 8.31E−46 |
| | 22 | 44324730 | C | T | rs738408 | PNPLA3 | syn | p.Pro149Pro | 0.014 (0.001) | 8.93E−46 |
| | 22 | 44368122 | A | G | rs3761472 | SAMM50 | mis | p.Asp110Gly | 0.011 (0.001) | 1.22E−22 |
| | 22 | 44395451 | T | C | rs1007863 | PARVB | mis | p.Trp37Arg | 0.006 (0.001) | 1.31E−13 |

| | | | Replication Cohorts | | | | | | |
|---|---|---|---|---|---|---|---|---|---|
| | | GHS Discovery | GHS Bariatric Surgery Cohort | | | Dallas Heart Study | | | U. Penn |
| Trait | Chr | Cohort N | Beta (SE) | P | N | Beta (SE) | P | N | Beta (SE) |
| ALT | 1 | 41,414 | 0.005 (0.005) | 3.10E−01 | 2475 | 0.011 (0.008) | 1.76E−01 | 1357 | 0.007 (0.004) |
| | 4 | 41,414 | −0.010 (0.005) | 5.57E−02 | 2475 | −0.016 (0.008) | 6.60E−02 | 1357 | −0.013 (0.004) |
| | 8 | 41,413 | −0.492 (0.165) | 2.84E−03 | 2475 | NA (NA) | NA | NA | −0.051 (0.072) |
| | 8 | 41,414 | −0.161 (0.165) | 3.29E−01 | 2475 | NA (NA) | NA | NA | −0.247 (0.143) |
| | 8 | 41,414 | −0.009 (0.020) | 6.48E−01 | 2475 | 0.032 (0.036) | 3.76E−01 | 1356 | −0.053 (0.018) |
| | 8 | 41,414 | −0.189 (0.165) | 2.50E−01 | 2475 | NA (NA) | NA | NA | −0.298 (0.101) |
| | 8 | 41,414 | −0.341 (0.074) | 3.64E−06 | 2475 | NA (NA) | NA | NA | −0.143 (0.054) |
| | 8 | 41,414 | −0.009 (0.020) | 6.45E−01 | 2475 | 0.028 (0.036) | 4.37E−01 | 1357 | −0.060 (0.018) |
| | 8 | 41,394 | −0.314 (0.165) | 5.71E−02 | 2475 | −0.317 (0.140) | 2.35E−02 | 1356 | −0.148 (0.143) |
| | 8 | 41,375 | −0.273 (0.048) | 9.83E−09 | 2474 | −0.240 (0.075) | 1.36E−03 | 1357 | −0.197 (0.041) |
| | 8 | 41,406 | −0.115 (0.058) | 4.82E−02 | 2475 | −0.106 (0.099) | 2.86E−01 | 1356 | −0.049 (0.041) |
| | 8 | 41,413 | −0.273 (0.050) | 4.26E−08 | 2475 | −0.191 (0.070) | 6.58E−03 | 1357 | −0.197 (0.041) |
| | 8 | 41,414 | −0.161 (0.165) | 3.29E−01 | 2475 | NA (NA) | NA | NA | −0.509 (0.203) |
| | 8 | 41,393 | −0.161 (0.165) | 3.29E−01 | 2475 | NA (NA) | NA | NA | −0.307 (0.143) |
| | 9 | 41,414 | −0.004 (0.005) | 4.09E−01 | 2475 | 0.004 (0.008) | 6.18E−01 | 1357 | −0.007 (0.004) |

TABLE 3-continued

Replication and joint meta-analysis of 35 exome-wide significant single nucleotide variants from the discovery cohort in three separate European-ancestry cohorts.

| | | | | | | | | | |
|---|---|---|---|---|---|---|---|---|---|
| | 9 | 41,412 | −0.004 (0.005) | 3.90E−01 | 2475 | 0.003 (0.008) | 7.33E−01 | 1356 | −0.007 (0.004) |
| | 10 | 41,414 | −0.002 (0.010) | 8.01E−01 | 2475 | −0.007 (0.017) | 6.88E−01 | 1357 | −0.017 (0.007) |
| | 10 | 41,414 | −0.003 (0.010) | 7.74E−01 | 2475 | −0.008 (0.017) | 6.28E−01 | 1357 | −0.017 (0.007) |
| | 10 | 41,414 | −0.003 (0.010) | 7.93E−01 | 2475 | −0.008 (0.017) | 6.28E−01 | 1357 | −0.017 (0.007) |
| | 10 | 41,414 | −0.001 (0.010) | 9.11E−01 | 2475 | −0.010 (0.017) | 5.40E−01 | 1357 | −0.016 (0.007) |
| | 10 | 40,834 | −0.010 (0.005) | 2.91E−02 | 2475 | −0.006 (0.007) | 4.02E−01 | 1356 | −0.009 (0.004) |
| | 10 | 41,414 | −0.006 (0.005) | 2.05E−01 | 2475 | 0.0001 (0.008) | 9.94E−01 | 1357 | −0.011 (0.004) |
| | 10 | 41,414 | −0.003 (0.005) | 5.80E−01 | 2475 | −0.013 (0.008) | 1.15E−01 | 1357 | −0.008 (0.004) |
| | 10 | 41,412 | −0.003 (0.005) | 5.61E−01 | 2475 | −0.013 (0.008) | 1.33E−01 | 1357 | −0.008 (0.004) |
| | 14 | 41,414 | 0.035 (0.020) | 7.97E−02 | 2475 | 0.034 (0.032) | 2.92E−01 | 1357 | 0.054 (0.013) |
| | 19 | 41,413 | 0.040 (0.010) | 2.40E−05 | 2475 | 0.024 (0.014) | 9.50E−02 | 1357 | 0.013 (0.008) |
| | 22 | 41,414 | 0.019 (0.006) | 5.54E−04 | 2475 | 0.006 (0.009) | 5.43E−01 | 1357 | 0.016 (0.004) |
| | 22 | 41,414 | 0.019 (0.006) | 5.51E−04 | 2475 | 0.006 (0.009) | 5.43E−01 | 1357 | 0.016 (0.004) |
| | 22 | 41,412 | 0.001 (0.005) | 7.77E−01 | 2475 | 0.005 (0.008) | 5.18E−01 | 1357 | 0.005 (0.004) |
| | 22 | 41,413 | 0.009 (0.006) | 1.66E−01 | 2475 | −0.001 (0.01) | 9.37E−01 | 1357 | 0.018 (0.005) |
| | 22 | 41,414 | 0.003 (0.005) | 5.22E−01 | 2475 | 0.008 (0.008) | 3.13E−01 | 1357 | 0.009 (0.004) |
| AST | 4 | 40,753 | −0.010 (0.003) | 3.12E−03 | 2469 | −0.012 (0.006) | 5.32E−02 | 1357 | −0.007 (0.004) |
| | 10 | 40,753 | −0.010 (0.003) | 2.91E−03 | 2469 | −0.003 (0.006) | 5.80E−01 | 1357 | −0.009 (0.004) |
| | 10 | 40,753 | −0.205 (0.062) | 8.57E−04 | 2469 | NA (NA) | NA | NA | −0.243 (0.088) |
| | 10 | 40,753 | NA (NA) | NA | NA | NA (NA) | NA | NA | 0.339 (0.079) |
| | 10 | 40,753 | −0.004 (0.003) | 1.54E−01 | 2469 | −0.007 (0.006) | 2.21E−01 | 1357 | −0.004 (0.003) |
| | 11 | 40,722 | −0.001 (0.003) | 7.85E−01 | 2466 | 0.006 (0.006) | 2.85E−01 | 1357 | −0.002 (0.003) |
| | 14 | 40,753 | 0.023 (0.013) | 7.79E−02 | 2469 | 0.044 (0.024) | 6.98E−02 | 1357 | 0.055 (0.011) |
| | 19 | 40,192 | 0.023 (0.006) | 1.99E−04 | 2469 | 0.010 (0.011) | 3.42E−01 | 1356 | 0.004 (0.007) |
| | 22 | 40,753 | 0.014 (0.004) | 1.27E−04 | 2469 | 0.004 (0.007) | 5.44E−01 | 1357 | 0.015 (0.004) |
| | 22 | 40,753 | 0.014 (0.004) | 1.32E−04 | 2469 | 0.004 (0.007) | 5.44E−01 | 1357 | 0.015 (0.004) |
| | 22 | 40,752 | 0.008 (0.004) | 6.03E−02 | 2469 | −0.001 (0.008) | 9.45E−01 | 1357 | 0.016 (0.004) |
| | 22 | 40,753 | 0.003 (0.003) | 4.12E−01 | 2469 | 0.006 (0.006) | 2.95E−01 | 1357 | 0.009 (0.003) |

| | | Replication Cohorts | | **Replication Meta-Analysis (N = 3) | | ***Joint Meta-Analysis (N = 4) | |
|---|---|---|---|---|---|---|---|
| | | U. Penn | | Beta | | Beta | |
| Trait | Chr | P | N | (SE) | P | (SE) | P |
| ALT | 1 | 1.02E−01 | 6158 | 0.007 (0.003) | 2.31E−02 | 0.008 (0.001) | 3.38E−09 |
| | 4 | 1.33E−03 | 6158 | −0.013 (0.003) | *3.85E−05 | −0.010 (0.001) | 1.17E−15 |
| | 8 | 4.79E−01 | 6158 | −0.121 (0.066) | 6.56E−02 | −0.155 (0.025) | 2.68E−10 |
| | 8 | 8.48E−02 | 6158 | −0.210 (0.108) | 5.23E−02 | −0.264 (0.031) | 5.54E−18 |
| | 8 | 3.72E−03 | 6158 | −0.025 (0.013) | 4.69E−02 | −0.032 (0.005) | 2.25E−12 |
| | 8 | 3.26E−03 | 6158 | −0.268 (0.086) | 1.88E−03 | −0.308 (0.033) | 2.79E−20 |

TABLE 3-continued

Replication and joint meta-analysis of 35 exome-wide significant single nucleotide variants from the discovery cohort in three separate European-ancestry cohorts.

| | | | | | | | |
|---|---|---|---|---|---|---|---|
| | 8 | 8.50E−03 | 6158 | −0.213 (0.044) | *1.14E−06 | −0.223 (0.013) | 4.49E−64 |
| | 8 | 5.60E−04 | 6158 | −0.031 (0.013) | 1.36E−02 | −0.033 (0.005) | 1.92E−12 |
| | 8 | 3.04E−01 | 6157 | −0.256 (0.086) | 2.79E−03 | −0.237 (0.029) | 1.94E−16 |
| | 8 | 1.31E−06 | 6157 | −0.231 (0.029) | *7.24E−16 | −0.225 (0.012) | 6.06E−78 |
| | 8 | 2.27E−01 | 6157 | −0.074 (0.032) | 1.88E−02 | −0.076 (0.012) | 7.03E−11 |
| | 8 | 1.31E−06 | 6158 | −0.221 (0.029) | *1.41E−14 | −0.224 (0.012) | 1.04E−77 |
| | 8 | 1.21E−02 | 6158 | −0.299 (0.128) | 1.93E−02 | −0.273 (0.030) | 6.44E−20 |
| | 8 | 3.21E−02 | 6158 | −0.244 (0.108) | 2.40E−02 | −0.189 (0.027) | 2.93E−12 |
| | 9 | 5.29E−02 | 6158 | −0.005 (0.003) | 8.42E−02 | −0.007 (0.001) | 3.08E−09 |
| | 9 | 4.24E−02 | 6158 | −0.005 (0.003) | 6.15E−02 | −0.007 (0.001) | 1.00E−09 |
| | 10 | 1.55E−02 | 6158 | −0.012 (0.005) | 3.43E−02 | −0.014 (0.002) | 3.44E−09 |
| | 10 | 1.70E−02 | 6158 | −0.012 (0.005) | 3.25E−02 | −0.014 (0.002) | 2.99E−09 |
| | 10 | 1.76E−02 | 6158 | −0.012 (0.005) | 3.43E−02 | −0.014 (0.002) | 3.23E−09 |
| | 10 | 2.77E−02 | 6158 | −0.011 (0.005) | 5.21E−02 | −0.014 (0.002) | 4.09E−09 |
| | 10 | 2.06E−02 | 6158 | −0.009 (0.003) | *1.14E−03 | −0.011 (0.001) | 1.76E−23 |
| | 10 | 3.91E−03 | 6158 | −0.008 (0.003) | 4.33E−03 | −0.009 (0.001) | 3.59E−15 |
| | 10 | 5.12E−02 | 6158 | −0.007 (0.003) | 2.07E−02 | −0.008 (0.001) | 3.28E−11 |
| | 10 | 4.77E−02 | 6158 | −0.007 (0.003) | 2.00E−02 | −0.008 (0.001) | 1.77E−11 |
| | 14 | 1.63E−05 | 6158 | 0.047 (0.010) | *2.82E−06 | 0.043 (0.004) | 1.59E−25 |
| | 19 | 7.51E−02 | 6158 | 0.024 (0.006) | *1.37E−05 | 0.016 (0.002) | 1.15E−12 |
| | 22 | 2.05E−04 | 6158 | 0.016 (0.003) | *7.45E−07 | 0.021 (0.001) | 3.55E−55 |
| | 22 | 2.14E−04 | 6158 | 0.016 (0.003) | *7.73E−07 | 0.021 (0.001) | 3.10E−55 |
| | 22 | 2.16E−01 | 6158 | 0.004 (0.003) | 1.91E−01 | 0.006 (0.001) | 6.24E−08 |
| | 22 | 4.02E−04 | 6158 | 0.012 (0.004) | *7.69E−04 | 0.018 (0.002) | 1.08E−31 |
| | 22 | 2.50E−02 | 6158 | 0.007 (0.003) | 1.78E−02 | 0.010 (0.001) | 1.16E−16 |
| AST | 4 | 5.56E−02 | 6166 | −0.009 (0.002) | *8.38E−05 | −0.006 (0.001) | 6.82E−13 |
| | 10 | 1.03E−02 | 6166 | −0.009 (0.002) | *1.16E−04 | −0.006 (0.001) | 1.10E−13 |
| | 10 | 5.97E−03 | 6165 | −0.218 (0.051) | *1.66E−05 | −0.220 (0.022) | 1.68E−24 |
| | 10 | 1.85E−05 | 6166 | 0.339 (0.079) | *1.85E−05 | 0.278 (0.025) | 3.25E−28 |
| | 10 | 1.94E−01 | 6166 | −0.005 (0.002) | 2.51E−02 | −0.005 (0.001) | 3.68E−10 |
| | 11 | 5.46E−01 | 6165 | 0.000 (0.002) | 8.43E−01 | 0.004 (0.001) | 1.13E−06 |
| | 14 | 4.01E−07 | 6166 | 0.042 (0.008) | *9.54E−08 | 0.029 (0.003) | 6.71E−26 |
| | 19 | 5.94E−01 | 6166 | 0.014 (0.004) | *1.20E−03 | 0.009 (0.002) | 5.92E−10 |
| | 22 | 4.87E−05 | 6166 | 0.013 (0.002) | *5.51E−08 | 0.014 (0.001) | 3.14E−52 |
| | 22 | 4.96E−05 | 6166 | 0.013 (0.002) | *5.81E−08 | 0.014 (0.001) | 3.55E−52 |
| | 22 | 2.64E−04 | 6166 | 0.010 (0.003) | *3.40E−04 | 0.011 (0.001) | 1.91E−25 |

TABLE 3-continued

Replication and joint meta-analysis of 35 exome-wide significant single nucleotide variants from the discovery cohort in three separate European-ancestry cohorts.

| | | | | | | |
|---|---|---|---|---|---|---|
| 22 | 6.17E−03 | 6166 | 0.006 (0.002) | 7.34E−03 | 0.006 (0.001) | 3.62E−15 |

*Indicates P-values meeting the Bonferroni significance threshold of $P < 1.43 \times 10^{-3}$.

**Replication meta-analysis includes the three replication cohorts: GHS Bariatric Surgery Cohort, Dallas Heart Study, and Penn Medicine Biobank.

***Joint meta-analysis includes the discovery cohort and the three replication cohorts: GHS Discovery Cohort, GHS Bariatric Surgery Cohort, Dallas Heart Study, and Penn Medicine Biobank.

Abbreviations:
AAF, alternate allele frequency;
Alt, alternate allele;
ALT, alanine aminotransferase;
AST, aspartate aminotransferase;
Ref, reference allele;
SE, standard error;
ann, annotation;
mis, missense;
syn, synonymous;
spl, splice donor;
stop, stop gained;
fs, frameshift;
inf, inframe indel.

Figure 5A:
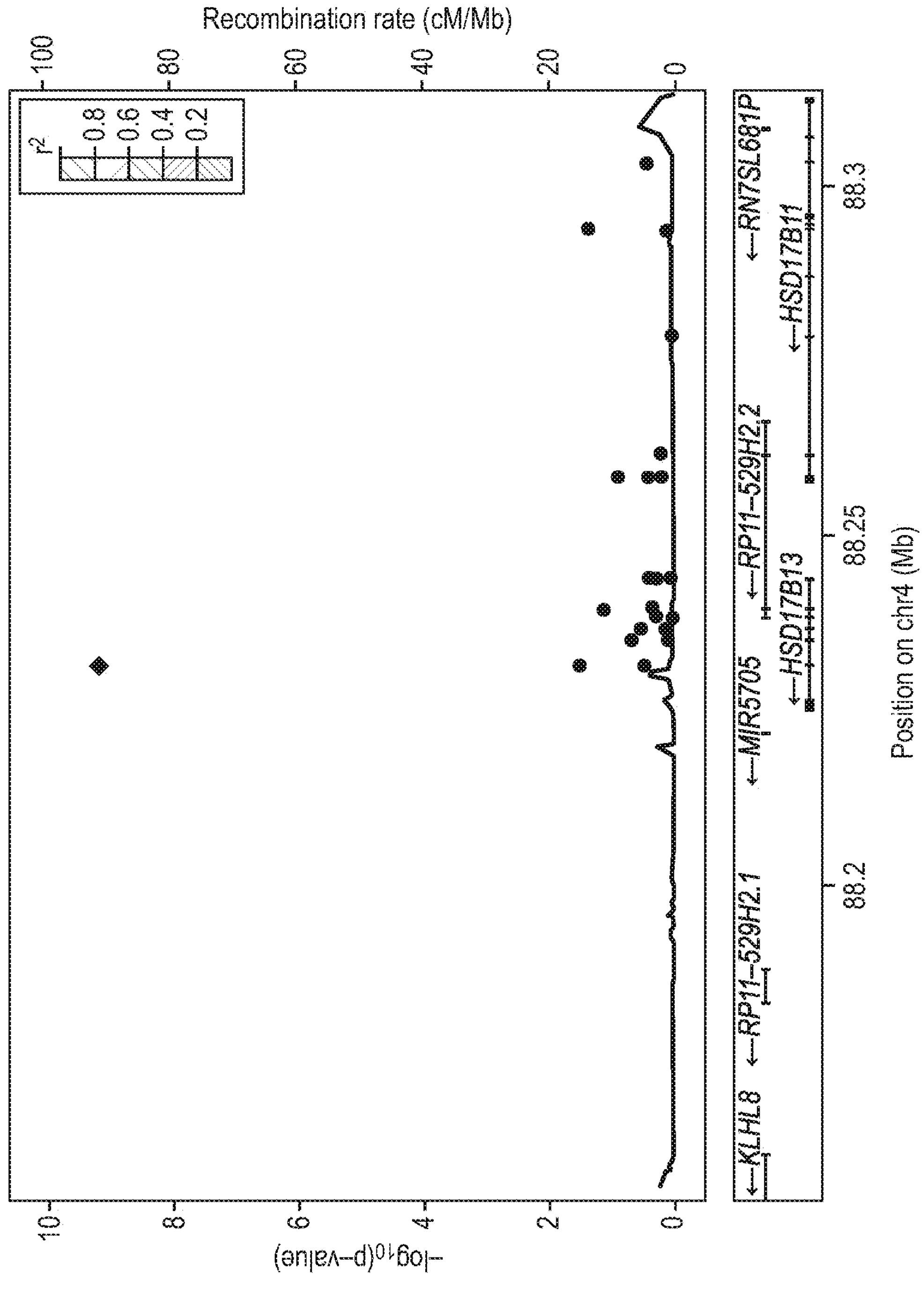
FIGS. 5A and 5B show locus-zoom plots of HSD17B13 (regional association plots in the region around HSD17B13) in the GHS discovery cohort for ALT and AST, respectively. No significant recombination across the region was observed. Diamonds indicate the splice variant rs72613567. Each circle indicates a single nucleotide variant with the color of the circle indicating the linkage disequilibrium ($r^2$ calculated in the DiscovEHR cohort) between that variant and rs72613567. Lines indicate estimated recombination rates in HapMap. The bottom panels show the relative position and the transcribed strand of each gene in the locus. There were no significant associations between ALT or AST and coding or splice region variants in the neighboring gene HSD17B11(most significant P-values $1.4\times10^{-1}$ and $4.3\times10^{-2}$ for ALT and AST, respectively).
Figure 5B:
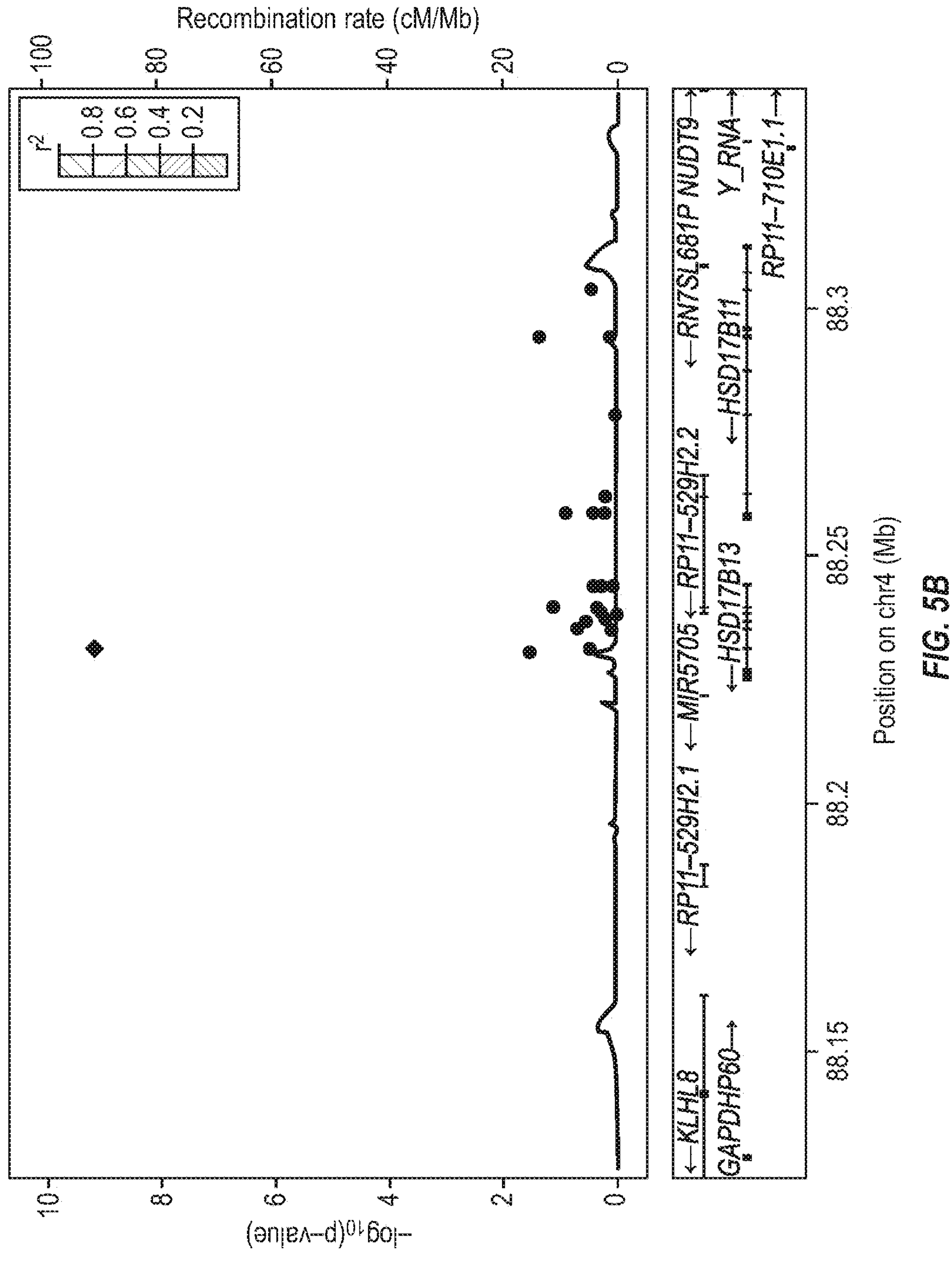
Figure 6B:
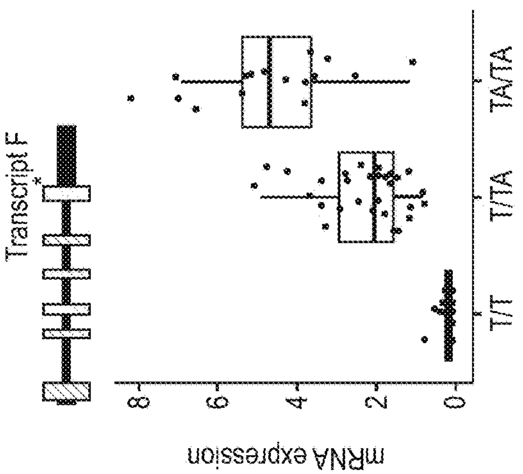
FIGS. 6A-6D show mRNA expression of four additional novel HSD17B13 transcripts (E-H) in homozygous reference (T/T), heterozygous (T/TA), and homozygous alternate (TA/TA) carriers of the HSD17B13 splice variant. Each transcript is illustrated with a corresponding gene model. Coding regions in gene models are indicated in striped boxes and untranslated regions in black boxes.
Figure 6A:
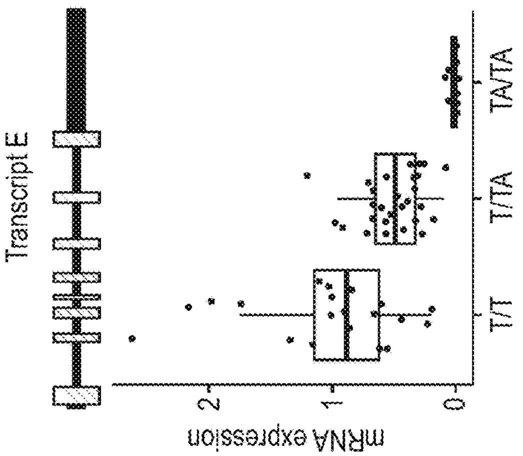
Figure 6D:
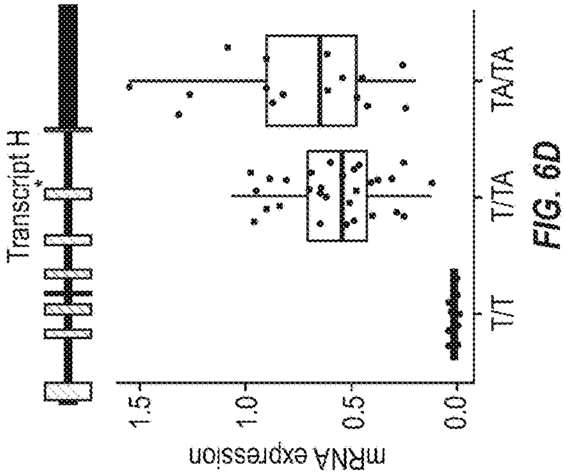
Figure 6C:
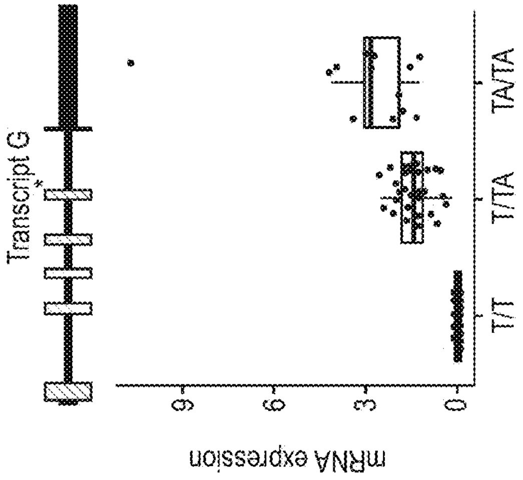

HSD17B13 is 30 kb upstream of HSD17B11, a member of the same gene family, and both genes lie within a single large haplotype block in Europeans. We did not observe any association between coding or splice variants in HSD17B11 and transaminase levels in the discovery cohort (FIGS. 5A and 5B; most significant discovery P-values $1.36\times10'^{1}$ for ALT and $4.32\times10^{-2}$ for AST) or in the joint meta-analysis of the discovery cohort and three replication cohorts (most significant P-values $6.25\times10^{-3}$; and $1.17\times10^{-5}$ for ALT and AST, respectively). Furthermore, linkage disequilibrium of rs72613567 with variants in HSD17B11 was modest across all ancestry groups, including in European Americans that largely comprise our discovery group, and also in Hispanic and African Americans represented in the Dallas Heart Study ($r^2<0.4$ with all ascertained variants in HSD17B11 in all ancestry groups; data not shown). Collectively, these findings suggest HSD17B13 as the gene in the genomic region that is most likely to be functionally related to transaminase levels.

Next, we sought to establish whether variants associated with ALT or AST levels were also associated with chronic liver disease. In the discovery cohort, we used EHR diagnosis codes to broadly define cases of alcoholic and nonalcoholic (non-viral) liver disease, as well as the following disease sequelae: alcoholic cirrhosis, nonalcoholic cirrhosis, and hepatocellular carcinoma (HCC). A common control group ("no liver disease") was defined as individuals with no diagnosis codes for any type of liver disease (Table 1). We tested the twelve transaminase-associated variants from the discovery and replication cohorts for association with chronic liver disease, using a Bonferroni significance threshold of P<0.05/24 ($P<2.08\times10^{-3}$) to account for the thirteen variants and two broad chronic liver disease categories (alcoholic and nonalcoholic) tested (Table 4). Overall, we found significant associations between six variants in five genes (HSD7B13, SERPINA1, T 46SF2, PNPLA3, and SAMM50) and chronic liver disease phenotypes. The SERPINA1, TM6SF2, PNPLA3, and SAMM50 associations confirm previously reported associations. Variants in GPT, GOT1, ERLIN1, and SLC39A12 were not significantly associated with any liver disease phenotype. The HSD17B13 association with liver disease reported here is novel and the first potentially protective genetic variant described.

TABLE 4

Association of twelve exome-wide significant and replicating single nucleotide variants with liver disease phenotypes in the discovery cohort.

| | | | Alcoholic liver disease | | Alcoholic cirrhosis | | Nonalcoholic liver disease |
|---|---|---|---|---|---|---|---|
| CHR:BP:Ref:Alt | Gene | rsID | OR (95% CI) | P-value | OR (95% CI) | P-value | OR (95% CI) |
| 4:88231392:T:TA | HSD17B13 | rs72613567 | 0.62 (0.48-0.81) | *1.82E−04 | 0.56 (0.41-0.78) | *3.35E−04 | 0.84 (0.78-0.91) |
| 8:145730161:C:T | GPT | rs201815297 | 3.83 (1.05-13.94) | 8.88E−02 | 6.33 (1.71-23.43) | 2.88E−02 | 0.23 (0.04-1.14) |
| 8:145732114:G:C | GPT | rs141505249 | 0.77 (0.06-10.73) | 8.43E−01 | 1.13 (0.08-15.39) | 9.30E−01 | 1.02 (0.49-2.11) |
| 8:145732180:G:C | GPT | rs147998249 | 0.73 (0.05-11.76) | 8.17E−01 | 1.07 (0.07-17.16) | 9.60E−01 | 1.03 (0.49-2.17) |
| 10:18242311:A:G | SLC39A12 | rs10764176 | 0.85 (0.68-1.07) | 1.64E−01 | 0.92 (0.70-1.22) | 5.80E−01 | 0.92 (0.86 (0.99) |
| 10:101157378:CGTT:C | GOT1 | | 4.60 (0.25-86.41) | 3.93E−01 | 7.11 (0.38-133.19) | 3.00E−01 | 2.37 (0.61-9.27) |
| 10:101165533:G:C | GOT1 | rs374966349 | 2.20 (0.13-37.68) | 6.24E−01 | 3.47 (0.20-59.04) | 4.70E−01 | 1.63 (0.53-4.96) |

TABLE 4-continued

Association of twelve exome-wide significant and replicating single nucleotide variants with liver disease phenotypes in the discovery cohort.

| | | | | | | | |
|---|---|---|---|---|---|---|---|
| 14:94844947:C:T | SERPINA1 | rs28929474 | 2.49 (1.49-4.17) | 2.30E−03 | 3.35 (1.93-5.83) | *3.01E−04 | 1.50 (1.21-1.87) |
| 19:19379549:C:T | TM6SF2 | rs58542926 | 1.47 (1.06-2.04) | 2.76E−02 | 1.35 (0.89-2.04) | 1.80E−01 | 1.36 (1.21-1.52) |
| 22:44324727:C:G | PNPLA3 | rs738409 | 1.76 (1.43-2.18) | *4.98E−07 | 2.07 (1.60-2.67) | *1.08E−07 | 1.65 (1.54-1.78) |
| 22:44324730:C:T | PNPLA3 | rs738408 | 1.77 (1.43-2.18) | *4.70E−07 | 2.07 (1.61-2.67) | *1.03E−07 | 1.65 (1.54-1.78) |
| 22:44368122:A:G | SAMM50 | rs3761472 | 1.90 (1.52-2.38) | *1.36E−07 | 2.28 (1.75-2.98) | *1.83E−08 | 1.52 (1.41-1.65) |

| | Nonalcoholic liver | Nonalcoholic cirrhosis | | Hepatocellular carcinoma | |
|---|---|---|---|---|---|
| CHR:BP:Ref:Alt | disease P-value | OR (95% CI) | P-value | OR (95% CI) | P-value |
| 4:88231392:T:TA | *1.31E−05 | 0.74 (0.62-0.88) | *4.48E−04 | 0.67 (0.45-1.00) | 4.66E−02 |
| 8:145730161:C:T | 1.86E−02 | 1.25 (0.24-6.38) | 7.98E−01 | 3.66 (0.70-19.01) | 2.01E−01 |
| 8:145732114:G:C | 9.70E−01 | 0.36 (0.02-5.37) | 3.82E−01 | 1.84 (0.15-23.25) | 6.88E−01 |
| 8:145732180:G:C | 9.30E−01 | 0.34 (0.02-5.59) | 3.67E−01 | 1.74 (0.11-27.05) | 7.21E−01 |
| 10:18242311: A:G | 3.43E−02 | 1.03 (0.88-1.21) | 7.15E−01 | 1.29 (0.93-1.79) | 1.37E−01 |
| 10:101157378:CGTT:C | 2.50E−01 | 8.27 (1.44-47.49) | 5.92E−02 | 9.81 (0.52-183.54) | 2.43E−01 |
| 10:101165533:G:C | 4.20E−01 | 1.17 (0.07-20.09) | 9.13E−01 | 5.37 (0.32-91.12) | 3.55E−01 |
| 14:94844947:C:T | *5.29E−04 | 2.99 (2.11-4.24) | *9.08E−08 | 1.86 (0.74-4.67) | 2.40E−01 |
| 19:19379549:C:T | *2.42E−07 | 1.64 (1.31-2.05) | *6.04E−05 | 1.93 (1.22-3.04) | 1.08E−02 |
| 22:44324727:C:G | *1.31E−41 | 2.05 (1.76-2.38) | *1.70E−19 | 2.20 (1.60-3.02) | *5.59E−06 |
| 22:44324730:C:T | *1.42E−41 | 2.05 (1.77-2.38) | *1.45E−19 | 2.20 (1.60-3.03) | *5.41E−06 |
| 22:44368122:A:G | *7.33E−24 | 1.86 (1.58-2.19) | *1.81E−12 | 1.66 (1.16-2.39) | 1.05E−02 |

*Indicates P-values meeting the Bonferroni significance threshold of $P < 2.08 \times 10^{-3}$.

Figure 2A:
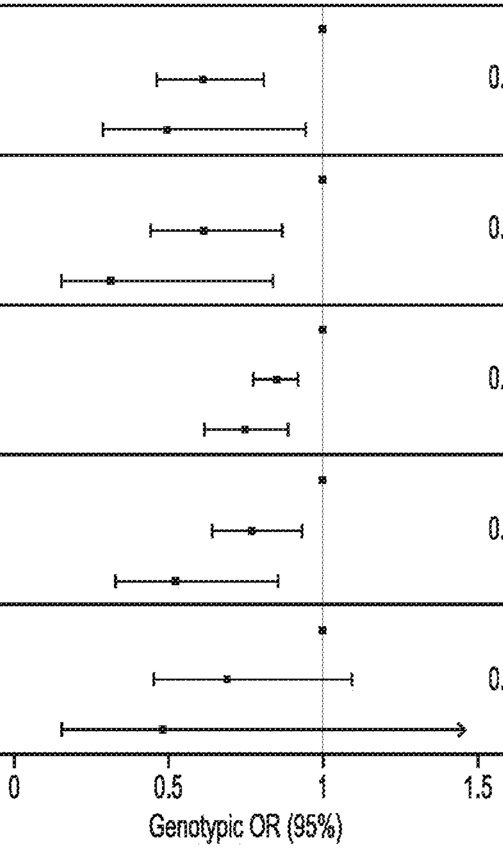
FIGS. 2A and 2B show that HSD17B13 rs72613567:TA is associated with reduced risk of alcoholic and nonalcoholic liver disease phenotypes in the discovery cohort (FIG. 2A), and with reduced risk of progression from simple steatosis to steatohepatitis and fibrosis in the bariatric surgery cohort (FIG. 2B). Odds ratios were calculated using logistic regression, with adjustment for age, $age^2$, sex, BMI, and principal components of ancestry. Genotypic odds ratios for heterozygous (Het OR) and homozygous (Het OR) carriers are also shown. In the GHS discovery cohort in FIG. 2A, variant HSD17B13 was associated with significantly reduced risk of nonalcoholic and alcoholic liver disease, cirrhosis, and hepatocellular carcinoma in an allele dosage-dependent manner. In the GHS bariatric surgery cohort in FIG. 2B, HSD17B13 rs72613567 was associated with 13% and 52% lower odds of nonalcoholic steatohepatitis (NASH), and 13% and 61% lower odds of fibrosis, in heterozygous and homozygous TA carriers, respectively.

The alternate (TA) allele of HSD17B13 rs72613567 was observed at higher frequency in controls compared to participants with any of the chronic liver disease phenotypes evaluated (FIG. 2A and Table 5). After adjustment for age, age$^2$, sex, BMI, and ancestry, we observed 38% lower odds of alcoholic liver disease (odds ratio [OR] 0.62; 95% confidence interval [C1]0.48-0.81, $P=1.8\times10^{-4}$) and 16% lower odds of nonalcoholic (non-viral) liver disease (OR 0.84, 95% CI 0.78-0.91, $P=1.3\times10^{-5}$) per TA allele. When restricting to cases with cirrhosis, the TA allele was associated with 44% lower odds of alcoholic (OR 0.56, 95% CI 0.41-0.78, $P=3.4\times10^{-4}$) and 26% lower odds of nonalcoholic (OR 0.74, 95% CI 0.62-0.88, P=4.5x10') cirrhosis. The TA allele was nominally associated with 33% lower odds of HCC per allele (OR 0.67, 95% CI 0.45-1.00, $P=4.7\times10^{-2}$). Unadjusted genotypic ORs suggested a co-dominant effect; for example, for alcoholic cirrhosis, the OR was 0.59 (95% CI 0.40-0.86) for heterozygous 1/TA carriers and 0.26 (95% CI 0.08-0.82) for homozygous TA/TA carriers, and for nonalcoholic cirrhosis, the OR was 0.75 (95% CI 0.61-0.93) for heterozygous and 0.55 (95% CI 0.34-0.91) for homozygous carriers.

Thus, in the discovery cohort, the alternate (TA) allele of HSD17B13 rs72613567 was associated with lower odds of all EHR-derived chronic liver disease phenotypes evaluated, in a consistent allele dosage-dependent manner (FIG. 2A): all categories of alcoholic liver disease, heterozygous odds ratio ($OR_{het}$) [95% confidence interval] 0.58 [0.42-0.79], homozygous OR ($OR_{hom}$) 0.46 [0.23-0.94], allelic OR ($OR_{allelic}$) 0.62 [0.48-0.81], P=1.82x10; all categories of nonalcoholic liver disease, $ORS_{het}$ 0.84 [0.76-0.92], $OR_{hom}$ 0.73 [0.59-0.89], $OR_{allelic}$ 0.84 [0.78-0.91], $P=1.31\times10^{-5}$. The TA allele was also associated with lower odds of the most advanced forms of these chronic liver diseases (as defined by EHR-derived diagnostic codes), namely alcoholic and nonalcoholic cirrhosis and HCC. The TA allele was associated with 42% and 73% lower odds of alcoholic cirrhosis for heterozygotes and homozygotes, respectively ($OR_{het}$ 0.59 [0.40-0.86], $OR_{hom}$ 0.26 [0.08-0.82], $OR_{allelic}$ 0.56 [0.41-0.78], $P=3.35\times10^{-4}$), 26% and 49% lower odds of nonalcoholic cirrhosis for heterozygotes and homozygotes, respectively ($OR_{het}$ 0.75 [0.61-0.93], $OR_{hom}$ 0.55 [0.34-0.91], $OR_{allelic}$ 0.74 [0.62 0.88], P=4.48x10). The TA allele was also nominally associated with lower odds of HCC.

Next, we sought to confirm and extend these findings in the multi-ethnic Dallas Liver Study (DLS) and the Dallas Pediatric Liver Study (DPLS), including African American, European American, and Hispanic American adults and children (Table 1B). In the DLS, the TA allele was associated with lower odds of any liver disease in an allele-dosage dependent manner ($OR_{het}$ 0.74 [0.57-0.97], $OR_{hom}$ 0.41

[0.21-0.83], $OR_{allelic}$ 0.70 [0.5-0.88], $P=1.77\times10^{-3}$, FIG. 8). Similar allele dosage-dependent effects were observed across EHR-derived liver disease subtypes, including protective associations with advanced, cirrhotic forms of alcoholic ($OR_{alleclic}$ 0.72 [0.53-0.99], $P=4.37\times10^{-2}$) and nonalcoholic ($OR_{alleclic}$ 0.65 [0.40-1.07], $P=8.96\times10^{-2}$) liver disease. In subset analyses of individuals grouped by self-reported ethnicity, the association with liver disease remained significant in Hispanic Americans, in particular, because of the high rate of liver disease in this subpopulation (n=326 cases and 722 controls, $OR_{alleclic}$, 0.51 [0.35-0.74], $P=3.98\times10^{-4}$), similar numerical trends, which did not achieve statistical significance, were also noted in the African American (n=33 cases and 2,291 controls, $OR_{alleclic}$ 0.74 [0.25-2.47], P=0.67) and European American (n=158 cases and 1,266 controls, $OR_{alleclic}$ 0.87 [0.65-1.15], P=0.32) subsets of the DLS. In the DPLS, a separate study of Hispanic American pediatric liver disease patients and obese controls (Table 1B), the TA allele was also associated with lower odds of liver disease ($OR_{alleclic}$ 0.59 [0.36-0.97], $P=3.6\times10^{-2}$). Thus, the HSD17B13 rs72613567:TA allele was associated with reduced odds of multiple forms of chronic liver disease, including cirrhosis, in adults and children in three independent populations.

Figure 2B:
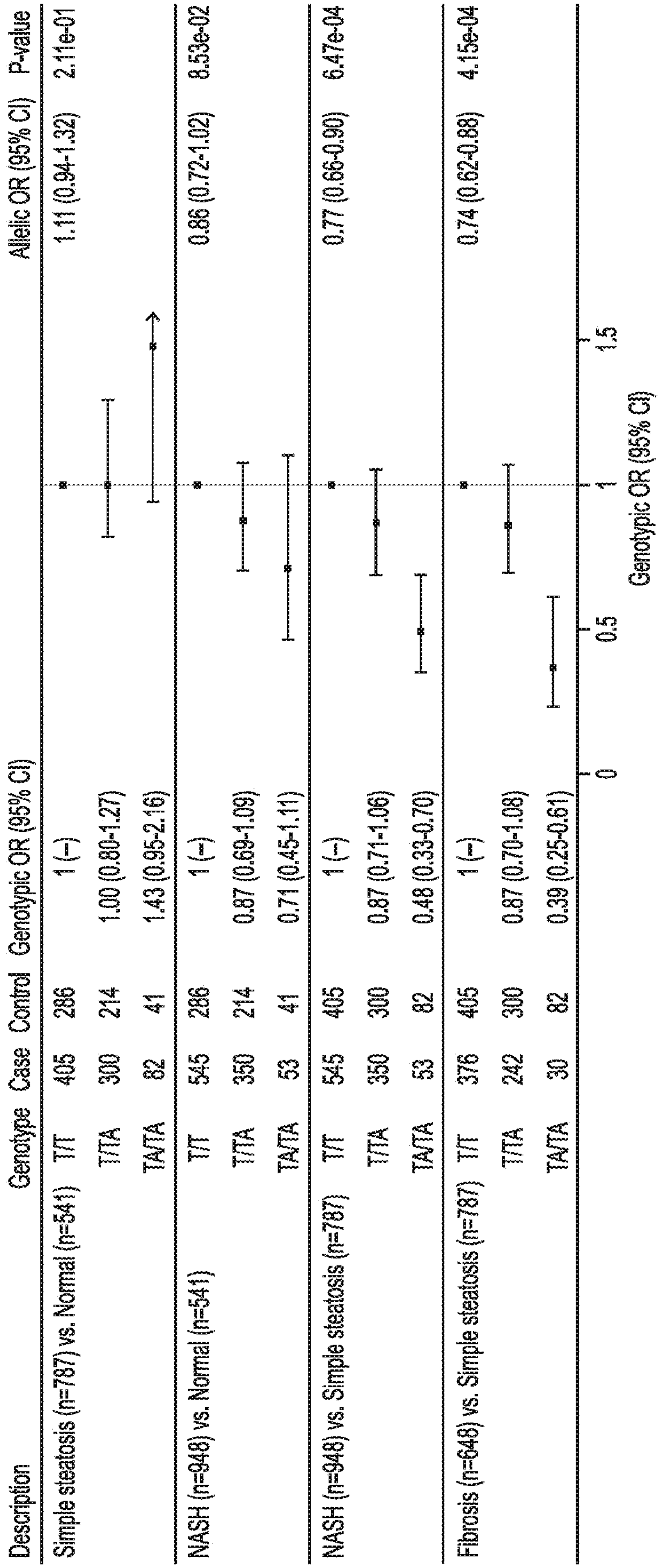
Figure 9:
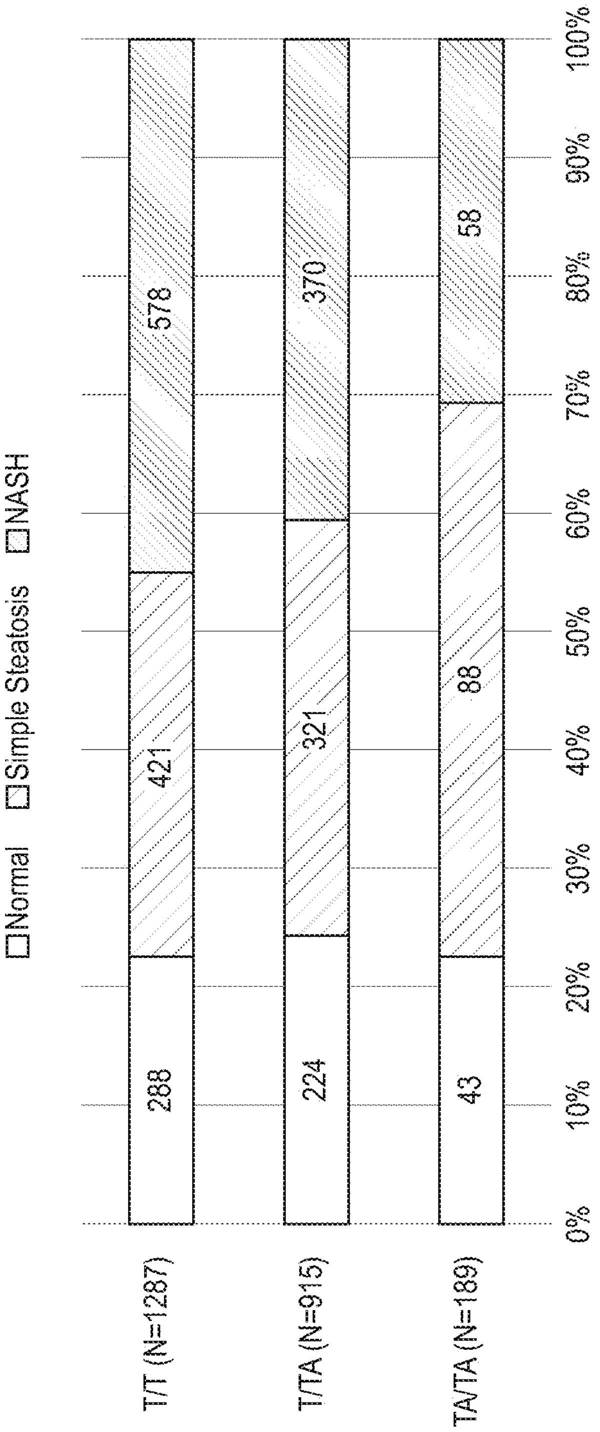
FIG. 9 shows HSD17B13 rs72613567 is associated with reduced risk of progression from simple steatosis to steatohepatitis and fibrosis. Specifically, it shows that prevalence of histopathologically-characterized liver disease according to HSD17B13 rs72613567 genotype in 2,391 individuals with liver biopsies from the GHS bariatric surgery cohort. The prevalence of normal liver did not appear to differ by genotype (P=0.5 by Chi-squared test for trend in proportions), but the prevalence of NASH decreased ($P=1.6\times10^{-4}$) and that of simple steatosis increased ($P=1.1\times10^{-3}$) with each TA allele.

NAFLD describes a spectrum of disease ranging from fatty liver without evidence of significant inflammation (designated as "simple steatosis" upon histopathological examination) to more clinically impactful manifestations (designated as "nonalcoholic steatohepatitis" (NASH), with histopathological evidence of lobular inflammation, hepatocyte ballooning, and/or fibrosis). To understand the relationship between the HSD17B13 TA allele and histologically defined NAFLD and NASH, we performed tests of association of rs72613567 in 2,391 whole exome sequenced individuals with liver biopsy samples from the GHS bariatric surgery cohort. Among these individuals, there were 555 (23%) with no evidence of steatosis, steatohepatitis, or fibrosis ("normal"), 830 (35%) with simple steatosis, and 1006 (42%) with NASH (i.e. evidence of lobular inflammation, hepatocyte ballooning, or fibrosis). The HSD17B13 TA allele was not significantly associated with simple steatosis (OR 1.11, 95% CI 0.94-1.32, P=0.21) or NASH (OR 0.86, 95% CI 0.72-1.05, P=0.09) compared to normal liver (FIG. 2B and Table 5). When comparing prevalence of normal liver, simple steatosis, and NASH by genotype, it was observed that the prevalence of normal liver did not appear to differ by genotype (23%, 24%, and 23% for T/T, T/TA, and TA/TA carriers, respectively, P=0.5 by Chi-squared test for trend in proportions), but that the prevalence of NASH decreased (45%, 40%, and 31% for T/T, T/TA, and TA/TA carriers, respectively, $P=1.6\times10^{-4}$) and that of simple steatosis increased (33%, 35%, and 47% for T/T, T/TA, and TA/TA carriers, respectively, $P=1.1\times10^{-3}$) with each TA allele (FIG. 9). Among individuals with steatosis, the TA allele was associated with statistically significantly lower odds of NASH, as compared to simple steatosis, in an allele dosage-dependent manner. On the background of simple steatosis, the TA allele was associated with 23% lower odds of NASH (OR 0.77, 95% CI 0.66-0.90, $P=6.5\times10^{-4}$, suggesting a role for HSD17B13 in mediating the progression of NAFLD to more advanced stages of NASH and fibrosis. Genotypic association results were consistent with a co-dominant effect; in the NASH vs. simple steatosis comparison, the OR was 0.84 (95% CI 0.69-1.02) for heterozygous T/TA carriers, and 0.48 (95% CI 0.34-0.68) for homozygous TA/TA carriers.

TABLE 5

HSD17B13 rs72613567 is associated with reduced risk of alcoholic and nonalcoholic liver disease phenotypes in the discovery cohort, and with reduced risk of progression from nonalcoholic fatty liver disease to nonalcoholic steatohepatitis and fibrosis in the bariatric surgery cohort.

| | | Cases | | | | Controls | | | |
|---|---|---|---|---|---|---|---|---|---|
| Cohort | Definitions | N | REF/REF | REF/ALT | ALT/ALT | Definitions | N | REF/REF | REF/ALT |
| Discovery cohort | Alcoholic liver disease | 197 | 133 | 56 | 8 | No liver disease | 30,522 | 16413 | 11969 |
| | Alcoholic cirrhosis | 130 | 89 | 38 | 3 | | | | |
| | Nonalcoholic liver disease | 1930 | 1131 | 692 | 107 | | | | |
| | Nonalcoholic cirrhosis | 381 | 235 | 129 | 17 | | | | |
| | Hepatocellular carcinoma | 76 | 49 | 24 | 3 | | | | |
| Bariatric surgery cohort | Simple steatosis | 830 | 421 | 321 | 88 | Normal | 555 | 288 | 224 |
| | NASH | 1006 | 578 | 370 | 58 | | | | |
| | NASH | 1006 | 578 | 370 | 58 | Simple steatosis | 830 | 421 | 321 |

| Cohort | Definitions | Controls ALT/ALT | AAF | Het OR (95% CI) | Hom OR (95% CI) | Per-allele OR (95% CI) | P-value |
|---|---|---|---|---|---|---|---|
| Discovery cohort | Alcoholic liver disease | 2140 | 0.266 | 0.58 (0.42-0.79) | 0.46 (0.23-0.94) | 0.62 (0.48-0.81) | 1.82E−04 |
| | Alcoholic cirrhosis | | 0.266 | 0.59 (0.40-0.86) | 0.26 (0.08-0.82) | 0.56 (0.41-0.78) | 3.35E−04 |
| | Nonalcoholic liver disease | | 0.264 | 0.84 (0.76-0.92) | 0.73 (0.59-0.89) | 0.84 (0.78-0.91) | 1.31E−05 |
| | Nonalcoholic cirrhosis | | 0.266 | 0.75 (0.61-0.93) | 0.55 (0.34-0.91) | 0.74 (0.62-0.88) | 4.48E−04 |

TABLE 5-continued

HSD17B13 rs72613567 is associated with reduced risk of alcoholic and nonalcoholic liver disease phenotypes in the discovery cohort, and with reduced risk of progression from nonalcoholic fatty liver disease to nonalcoholic steatohepatitis and fibrosis in the bariatric surgery cohort.

| | | | | | | | |
|---|---|---|---|---|---|---|---|
| | Hepatocellular carcinoma | | 0.266 | 0.67 (0.41-1.10) | 0.47 (0.15-1.51) | 0.67 (0.45-1.00) | 4.66E−02 |
| Bariatric surgery cohort | Simple steatosis | 43 | 0.291 | 0.98 (0.78-1.23) | 1.39 (0.94-2.08) | 1.11 (0.94-1.32) | 2.11E−01 |
| | NASH | | 0.255 | 0.82 (0.66-1.02) | 0.67 (0.44-1.02) | 0.86 (0.72-1.02) | 8.53E−02 |
| | NASH | 88 | 0.268 | 0.84 (0.69-1.02) | 0.48 (0.34-0.68) | 0.77 (0.66-0.90) | 6.47E−04 |

Figure 3A:
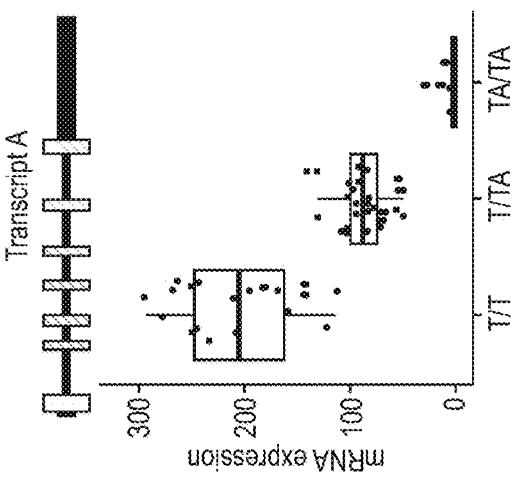
FIGS. 3A-3D show expression of four HSD17B13 Transcripts (A-D) in homozygous reference (T/T), heterozygous (T/TA), and homozygous alternate (TA/TA) carriers of the HSD17B13 rs72613567 splice variant. Each transcript is illustrated with a corresponding gene model. Coding regions in gene models are indicated in the striped boxes and untranslated regions in the black boxes.
Figure 3B:
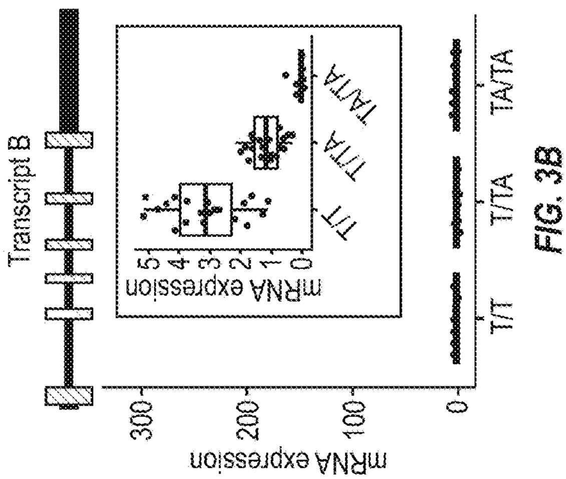
Figure 3C:
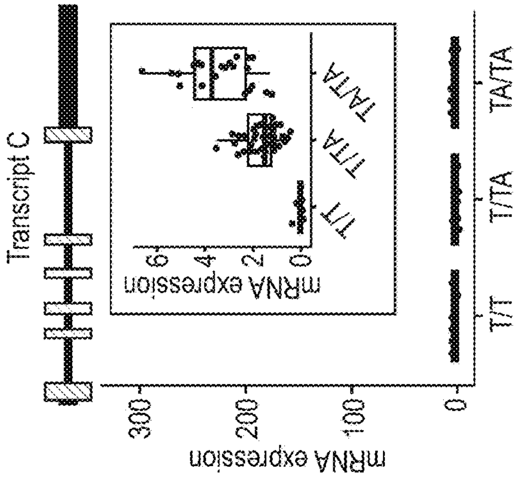
Figure 3D:
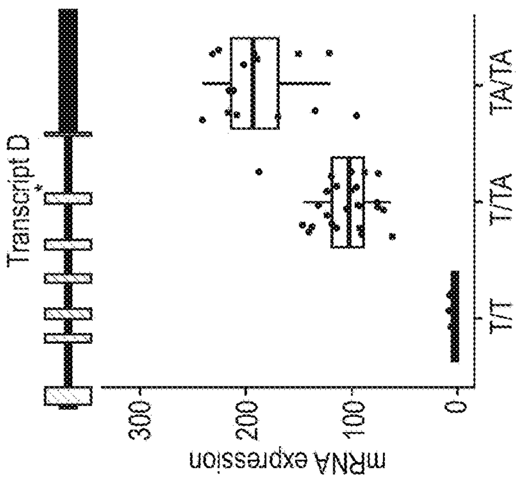

We next sought to understand how the HSD17B13 TA allele affects expression of known and novel transcripts of the gene. We used RNA sequencing to assess HSD17B13 mRNA expression in histologically normal liver samples from 22 homozygous reference (T/T), 30 heterozygous (T/TA), and 17 homozygous alternate (TA/TA) carriers of the HSD17B13 rs72613567 splice variant (FIG. 3). In addition to the two known HSD17B13 transcripts, A and B, two novel transcripts were identified: transcript C lacking exon 6, and transcript D characterized by the insertion of a G nucleotide at the 3' end of exon 6, leading to premature protein truncation. Novel transcripts were validated by RT-PCR, and the D transcript was additionally validated by long read cDNA sequencing. The expression levels of these transcripts varied according to HSD17B13 rs72613567 genotype; levels of transcripts A and B decreased, while those of transcripts C and D increased in an allele-dose-dependent manner in T/TA heterozygotes and TA/TA homozygotes (FIG. 3). Transcript A, encoding a 300 amino acid protein, was the predominant transcript in T/T in T/T homozygotes (FIG. 3A), while transcript D, encoding the prematurely truncated protein, was the predominant transcript in TA/TA homozygotes (FIG. 3D). These expression patterns suggest a functional role for HSD17B13 rs72613567 in determining HSD17B13 isoform expression. Four additional transcripts (E-H) with very low levels of expression were also identified (FIG. 6A-6D). Protein sequence alignment of all identified HSD17B13 isoforms is shown in FIG. 7.

HSD17B13 has been previously described as a lipid-droplet associated protein in human hepatocytes (Su et al. (2014) *Proc Natl Acad Sci USA* 111:11437-11442, herein incorporated by reference in its entirety for all purposes). We evaluated protein isoform expression and localization in a perpetual human liver cell line (HepG2 hepatoma cells) stably transduced with lentivirus expressing known and novel isoforms A-D of HSD17B13. HSD17B13 isoform A localized to lipid droplets in untreated and oleic acid-treated cells. Isoform A was mainly detected on membranes surrounding BODIPY-labeled lipid droplets, and co-localized with the lipid droplet coat protein perilipin (PLIN). Similar subcellular localization was observed for HSD17B13 isoform D at the lipid droplet surface; however, lipid droplets appeared larger following oleic acid treatment. In contrast, isoforms B and C co-localized with the endoplasmic reticulum marker calnexin.

In summary, using exome sequence data linked to ERR and liver biopsy data from 49,188 individuals from the DiscovEHR study population, and in follow-up studies of exome sequence data from 9,883 additional individuals with ALT and AST measurements, we discovered a novel association between a splice variant in HSD17B13, transaminase levels, and chronic liver disease phenotypes. In our study, variant HSD17B13 reduced the risk of nonalcoholic and alcoholic liver disease, and cirrhosis. This, to our knowledge, is the first report of an exonic variant with a protective association with chronic liver disease phenotypes. The HSD17B13 TA allele was not associated with simple steatosis, but reduced the risk of histopathologic steatohepatitis in individuals with steatosis, suggesting a role for HSD17B13 in progression to more clinically advanced stages of chronic liver disease. The consistency of protective associations in four independent cohorts (GHS discovery, GHS bariatric, DLS, and DPLS) across several different liver disease categories, characterized using EHR diagnosis codes as well as histopathological definitions of liver disease, together with the striking allele dosage-dependence of the associations, support the notion that the reported HSD17B13 variant protects from progression to more clinically advanced stages of chronic liver disease. The observed allele dosage-dependence also argues that more profound regulation of HSD17B13 function may result in more profound effects on disease risk and progression.

Other 17beta-hydroxysteroid dehydrogenase family members are known to be involved in sex steroid and fatty acid metabolism (Moeller and Adamski (2009) *Mol Cell Endocrinol* 301:7-19, herein incorporated by reference in its entirety for all purposes), but little is known about the function of HSD17B13. H5D17B13 is expressed primarily in the liver (Liu et al. (2007) *Acta Biochim Pol* 54:213-218, herein incorporated by reference in its entirety for all purposes), where it localizes to lipid droplets (Su et al. (2014) *Proc Natl Acad Sci USA* 111:11437-11442, herein incorporated by reference in its entirety for all purposes), consistent with a role for HSD17B13 in the pathogenesis of fatty liver disease. Our data are consistent with recent findings that HSD17B13 overexpression increased lipogenesis in mouse liver, and increased the number and size of lipid droplets in cultured hepatocytes (Su et al. (2014) *Proc Natl Acad Sci USA* 111:11437-11442, herein incorporated by reference in its entirety for all purposes). Two previous studies have also shown that hepatic expression of HSD17B13 protein is increased in patients with fatty liver (Su et al. (2014) *Proc Natl Acad Sci USA* 111:11437 11442 and Kampf et al. (2014) FASEB J 28:2901-2914, each of which is herein incorporated by reference in its entirety for all purposes). Two genes with variants that have been reported to be associated with increased risk of liver disease—PNPLA3 and 1M6SF2—also have physiological roles in hepatocyte lipid metabolism. The variant in HSD17B13 that we describe here is the first protective variant for liver disease, and may provide an avenue to new therapeutic strategies targeting chronic liver disease, similar to genetic variants that have guided the way to new therapeutics in other domains.

Overall, our data support HSD17B13 as a novel therapeutic target to reduce the risk of chronic liver disease in humans. Importantly, our data indicate that targeting of HSD17B13 could reduce progression from NAFLD to later stages of NASH, fibrosis, and cirrhosis, which are associated with significant morbidity and mortality, and for which there are currently no effective treatments.

Methods

Study Participants. Human genetics studies were conducted as part of the DiscovEHR collaboration of the Regeneron Genetics Center and the Geisinger Health System (GHS). The study was approved by the GHS Institutional Review Board. The two DiscovEHR study populations (discovery cohort and bariatric surgery cohort) originated from the first 50,726 consented participants ≥18 years of age from the MYCODE® Community Health Initiative of GHS (Dewey et al. (2016) Science 354(6319) doi: 10.1126/science. aaf68 14, herein incorporated by reference in its entirety for all purposes). The GHS discovery cohort consisted of 46,544 European individuals recruited from outpatient primary care and specialty clinics between 2007 and 2016, excluding all those recruited to the bariatric surgery cohort. The GHS bariatric surgery cohort consisted of 2,644 European individuals who had been referred for bariatric surgery.

Replication studies included 1,357 European individuals from the Dallas Heart Study and 8,527 European individuals from the Penn Medicine Biobank. The Dallas Heart Study is a probability-based population cohort study of Dallas County residents aged 30 to 65 years (Victor et al. (2004) *Am J Cardiol* 93:1473-1480, herein incorporated by reference in its entirety for all purposes. The Penn Medicine Biobank includes participants recruited from the University of Pennsylvania Health System and consented for biospecimen storage, access to ERR data, and permission to recontact.

Replication studies of the associations with chronic liver disease included 517 individuals from the Dallas Liver Study (DLS) and 447 individuals from the Dallas Pediatric Liver Study (DPLS). The DLS is a biobank of patients with liver disease of non-viral etiology. Recruitment began in January 2015 and is ongoing. Participants were recruited from liver clinics at UT Southwestern and Parkland Health and Hospital System, Dallas. The biobank was approved by the UT Southwestern Institutional Review Board. Participants provided written informed consent. Participants completed a questionnaire on ethnic/racial background, medical history, lifestyle factors, and family history of liver disease and other diseases. Additional clinical information was extracted from medical records by a trained technician. We included all African American, European American, and Hispanic American patients with DNA available at the time of the present study (n=517). The DPLS is a biobank of children recruited from pediatric liver clinics at UT Southwestern and Parkland Health and Hospital System, Dallas, and from an obesity clinic at Children's Medical Center, Dallas. The biobank was approved by the UT Southwestern Institutional Review Board. The legal guardians of the participants provided written informed consent. Clinical information was extracted from medical records by a trained technician. As more than 95% of the patients were Hispanic Americans, we only included Hispanic American patients and controls in the present study (n=203 patients and 244 controls).

Sample Preparation and Sequencing. Sample preparation and whole exome sequencing were performed at the Regeneron Genetics Center as previously described (Dewey et al. (2016) *Science* 354(6319) doi: 10.1126/science.aaf68 14, herein incorporated by reference in its entirety for all purposes). In brief, exome capture was performed using NimbleGen probes according to the manufacturer's recommended protocol (Roche NimbleGen). The captured DNA was PCR amplified and quantified by qRT-PCR (Kapa Biosystems). The multiplexed samples were sequenced using 75 bp paired-end sequencing on an Illumina v4 HiSeq 2500 to a coverage depth sufficient to provide greater than 20× haploid read depth of over 85% of targeted bases in 96% of samples (approximately 80× mean haploid read depth of targeted bases). Raw sequence data from each Illumina Hiseq 2500 run were uploaded to the DNAnexus platform (Reid et al. (2014) *BMC Bioinformatics* 15, 30 doi:10.1186/1471-2105-15-30) for sequence read alignment and variant identification. In brief, raw sequence data were converted from BCL files to sample-specific FASTQ-files, which were aligned to the human reference build GRCh37.p 13 with BWA-mem (Li and Durbin (2009) *Bioinformatics* 25:1754-1760, herein incorporated by reference in its entirety for all purposes). Single nucleotide variants (SNV) and insertion/deletion (indel) sequence variants were identified using the Genome Analysis Toolkit (McKenna et al. (2010) *Genome Res* 20:1297-1303, herein incorporated by reference in its entirety for all purposes).

Targeted Genotyping of rs72613567 in the Dallas Liver and Pediatric Liver Studies. HSD17B13 rs72613567 was genotyped by TAQMAN® assay in the Dallas Liver Study and Dallas Pediatric Liver Study, and by exome sequencing in the Dallas Heart Study. TAQMAN® calls were verified by Sanger sequencing of 5 individuals with each genotype.

Clinical Measurements and Chronic Liver Disease Definitions in the Discovery Cohort. Clinical laboratory measurements for ALT and AST were extracted from EHRs of participants from the GHS discovery cohort and bariatric surgery cohort. Median ALT and AST values were calculated for all participants with two or more measurements, and were $\log_{10}$ transformed to normalize the distribution prior to association analyses.

International Classification of Diseases Ninth Revision (ICD-9) disease codes were extracted from EHRs and collapsed into clinical disease categories for non-viral, nonalcoholic (ICD-9 571.40, 571.41, 571.49, 571.5, 571.8, 571.9) or alcoholic (ICD-9 571.0, 571.1, 571.2, 571.3) liver disease case definitions. Additional case definitions based on single diagnosis codes included: alcoholic cirrhosis (ICD-9 571.2), nonalcoholic cirrhosis (ICD-9 571.5), and HCC (ICD-9 155.0). For these case definitions, a common control group without liver disease was defined as participants with no case criteria or single-encounter or problem-list diagnosis code indicating any type of liver disease.

Liver Histopathologic Phenotype Definitions in the Bariatric Surgery Cohort. The GHS bariatric surgery cohort consisted of 2,644 individuals of European descent, with intra-operative liver biopsy specimens available from 2,391 of these individuals. Liver biopsy specimens were formalin-fixed and stained with hematoxylin and eosin for routine histology, and Masson's trichrome stain for assessment of fibrosis, as previously described (Gerhard et al. (2011) *Patient Saf Surg* 5, 1, doi:10.1186/1754-9493-5-1, herein incorporated by reference in its entirety for all purposes). Histologic diagnoses were determined by hepatopathologists using previously established criteria (Brunt et al. (1999) *Am J Gastroenterol* 94:2467-2474, herein incorporated by reference in its entirety for all purposes). Histologic diagnoses were used to defined the following phenotypes: 1) Normal: no evidence of steatosis, NASH, or fibrosis; 2) Simple steatosis: Steatosis (regardless of grade) with no evidence of NASH or fibrosis; 3) NASH/fibrosis: Any presence of lobular inflammation or hepatocyte ballooning (regardless of grade), or any presence of fibrosis (regardless of stage); 4) Fibrosis: Any presence of fibrosis (regardless of stage).

Exome-Wide Association Analysis of Liver Enzymes. In the GHS discovery cohort, we tested 502,219 biallelic variants with missing data rate <1%, Hardy-Weinberg equilibrium p-value $>1.0\times10^{-6}$, and minor allele frequency >0.1% for association with transaminase levels. $Log_{10}$-transformed median ALT and AST were adjusted for age, $age^2$, sex, BMI, and the first four principal components of ancestry. To account for relatedness among study participants, we also fit a genetic relatedness matrix as a random-effects covariate. Both principal components and the genetic relatedness matrix were constructed from 39,858 non-MHC markers in approximate linkage equilibrium and with minor allele frequency >0.1%. We used linear mixed models as implemented in the GCTA package (Yang et al. (2011) *Am J Hum Genet* 88:76-82, herein incorporated by references in its entirety for all purposes) to test for association between trait residuals and single nucleotide variants. The tests were well-calibrated, as shown by exome-wide quantile-quantile plots and genomic control lambda values (FIG. 1).

Replication Meta-Analysis of Liver Enzyme Associations. We attempted to replicate associations in the GHS discovery cohort in three separate European-ancestry cohorts: the GHS bariatric surgery cohort, the Dallas Heart Study, and the Penn Medicine Biobank (described above). ALT and AST measures in the GHS bariatric surgery cohort and from Penn Medicine Biobank were $log_{10}$-transformed and adjusted for age, $age^2$, sex, BMI, and the first four principal components of ancestry. ALT and AST measures from the Penn Medicine Biobank samples were $log_{10}$-transformed and adjusted for age, $age^2$, sex, BMI, and the first four principal components of ancestry. Genetic relatedness matrices were included as random-effects covariates, and analysis was performed using linear mixed models in GCTA. In the Dallas Heart study, $log_{10}$-transformed ALT and AST measures were adjusted for age, $age^2$, sex, and the first ten principal components of ancestry, and analysis was performed using linear regression implemented in PLONK. Summary statistics for the three replication cohorts were meta-analyzed using METAL (replication meta-analysis) (Willer et al. (2010) *Bioinformatics* 26:2190-2191, herein incorporated by reference in its entirety for all purposes). Summary statistics for the discovery cohort and the three replication cohorts were meta-analyzed similarly (joint meta-analysis).

Association Analysis with Chronic Liver Disease Phenotypes. We analyzed nine significant and replicated single nucleotide variants from the liver enzyme ExWAS for associations with binary liver disease phenotypes defined from the GHS discovery cohort, as described above. We used a Bonferroni significance threshold of P<0.05/26 ($P<1.92\times10^3$) to account for the thirteen variants and two broad chronic liver disease categories (alcoholic and non-alcoholic) tested. Variant HSD17B13 was further tested for association with histopathologically defined liver phenotypes from the GHS bariatric surgery cohort, as described above. Odds ratios were estimated with the use of Firth's penalized likelihood method of logistic regression after adjustment for age, $age^2$, sex, BMI, and the first four principal components of ancestry. Unadjusted genotypic odds ratios were also estimated for HSD17B13 rs72613567.

Odds ratios for liver disease in the DLS were estimated by logistic regression, adjusted for age, $age^2$, gender, BM, and self-reported ethnicity. Participants from the Dallas Heart Study with available rs72613567 genotypes were used as normal controls (n=4,279). Odds ratios in the DPLS were estimated by logistic regression.

Software. Genetic association analyses were performed using GCTA software, version 1.25.0 (Yang et al. (2011) *Am J Hum Genet* 88:76-82, herein incorporated by reference in its entirety for all purposes), and PLINK, version 1.9.0. Quantile-quantile and Manhattan plots were generated using R software, version 3.2.1 (R Project for Statistical Computing). Regional association plots were generated using LocusZoom (Pruim et al. (2010) *Bioinformatics* 26:2336-2337, herein incorporated by reference in its entirety for all purposes).

RNA Sequencing Studies. RNA quality and concentration was evaluated by running total RNA on an Agilent RNA Nano Bioanalyzer chip; all samples had an RNA integrity number (RIN) greater than 8. Polyadenlylated RNA transcripts were isolated using two rounds of enrichment with oligo(dT)25 beads (Thermo Fisher Scientific). Samples were purified and concentrated with RNAclean XP beads (Beckman Coulter) and heat-fragmented to approximately 140 base pairs. First-strand synthesis was completed with SuperScript III reverse transcriptase (Thermo Fisher Scientific) using random hexamers; dTTP was replaced with dUTP during second-strand synthesis. Samples were processed according to our standard DNA library preparation method referenced above for exomes with the addition of a uracil DNA-glycosylase step to generate strand-specific sequencing libraries. Samples were pooled and sequenced using 75 bp paired-end sequencing on an Illumina v4 HiSeq 2500.

Identification of Novel HSD17B13 Transcripts. Reads were mapped to the Human.B38 using ARRAYSTUDIO® software (OMICSOFT®, Cary, NC) allowing two mismatches. Two approaches were employed to identify novel HSD17B13 transcripts. Novel exon junctions were discovered based on Gencode v24. De novo transcript assembly was run using Trinity (v2.2.0) in default setting. Custom gene models were built to incorporate novel transcripts of HSD17B13, and transcript quantification was estimated by read alignment to the custom gene model. Protein sequence alignment of all identified HSD17B13 isoforms is shown in FIG. 7.

RT-PCR Validation of Novel Transcripts. RT-PCR on total RNA from human liver samples was performed using the SUPERSCRIPT™ One-Step RT-PCR System with Platinum™ Taq DNA Polymerase (Thermofisher). Each 50 µL RT-PCR reaction contained 1× Reaction Mix, 500 nM each forward and reverse primers (PST516: ATGAACATCATCCTAGAAATCCTTC (SEQ ID NO: 251) and PST517: ATCATGCATACATCTCTGGCTGGAG (SEQ ID NO: 252)), 1 µL of RT/Platinum Taq, and 75 ng RNA. Cycling conditions were: one cycle of 45 °C for 30 min; one cycle of 94 °C for 2 min; 40 cycles of 94 °C for 20 s, 53 °C for 30 s, and 72 °C for 90 s, one cycle of 72 °C for 5 min; then a 10 °C hold. Products were purified using the QIAquick PCR Purification Kit (Qiagen) and submitted for direct Sanger sequencing using the primer DE002 (ATCAGAACTTCAGGCCTTGG (SEQ ID NO: 253)). To identify the B and C transcripts, the RT-PCR products were run out on a 2% agarose gel stained with SYBR GOLD-SYBR Gold Nucleic Acid Gel Stain (Thermofisher), and bands of the expected molecular weight were excised and purified using the QlAquick Gel Extraction Kit (Qiagen), then subjected to cloning with the TOPO® TA Cloning Kit (Thermofisher). Sequencing of the TOPO clones was performed using, M13F and M13R sequencing primers. Sequence analysis was performed using the Sequencher DNA analysis software (Gene Codes Corporation).

PacBio Validation of Novel Transcripts. Full-length HSD17B13 transcripts were amplified directly from 50 ng of total RNA with the SuperScript III One-step RT-PCR System with Platinum Taq High Fidelity (Thermo Fisher Scientific) using gene-specific primers in the first (GCAAAGCCATGAACATCATCC (SEQ ID NO: 254) and last exons (TCTTGATGTAGTGGGAGTCGGATT (SEQ ID NO: 255)) to generate an amplicon of ~2.2 kb (maximum predicted size transcript). Amplicons were verified on an Agilent Bioanalyzer. PacBio-compatible barcoded adapters were ligated to the amplicons and cleaned with PacBio PB beads (Pacific Biosciences). Libraries were pooled in equal amounts and sequenced on one SMRT cell for 180 min on the PacBio RSII platform. The data were demultiplexed using PacBio software smrtanalysis v2.3 tool labelzmw and then analyzed with ConsensusTools AmpliconAnalysis. Resulting amplicons were compared to HSD17B13 RefSeq genes to determine isoform and genotype status.

Subcellular Localization of HSD17B13 Isoforms. HepG2 cells were cultured in Eagle's Minimum Essential Medium supplemented with 10% fetal bovine serum. HSD17B13 Transcripts A, B, C, and D were sub-cloned into Myc-DDK backbone lentivirus constructs, and lentivirus were generated. HepG2 cells were infected with lentivirus carrying the various HSD17B13 transcripts. Stable cell lines expressing each HSD17B13 transcript were selected with 1-3 mg/ml Geneticin G-418 sulfate in complete culture medium for two weeks. Selected HepG2 cells were treated with or without 200 μM oleic acid overnight then fixed. HSD17B13 isoforms were labeled with mouse anti-Myc antibody. Lipid droplets were labeled with BODIPY FL dye (Sigma). Lipid coat protein and endoplasmic reticulum were labeled with rabbit anti-PLIN antibody (Sigma) and rabbit anti-calnexin antibody (Cell Signaling Technology), respectively. Secondary antibodies for immunofluorescence were Alexa Fluor 488 donkey anti-rabbit IgG and Alexa Fluor 594 donkey anti-mouse IgG (Jackson ImmunoResearch).

Example 2. Effect of rs72613567:TA on HSD17B13 mRNA and HSD17B13 Protein Expression The effect of the HSD17B13 rs72613567:TA allele on expression of known and novel transcripts of the gene was examined. RNA sequencing was used to assess HSD17B13 mRNA expression in histologically normal liver samples from 22 T/T homozygous, 30 T/TA heterozygous, and 17 TA/TA homozygous carriers of the HSD17B13 rs72613567 splice variant. In addition to the two known HSD17B13 transcripts, A and B, two novel transcripts were identified: Transcript C, which lacked exon 6, and Transcript D which contained an insertion of a guanine nucleotide at the 3' end of exon 6, which would be predicted to result in premature truncation of the protein. The transcripts were validated by RT-PCR and Sanger sequencing (data not shown). The D transcript was also validated using long read cDNA sequencing. The expression levels of these transcripts varied according to HSD17B13 rs72613567 genotype; levels of transcript A decreased, while the level of transcripts D increased in an allele dosage-dependent manner with each TA allele (see FIGS. 3A, 3D, and 10B). Transcript A, which encodes the full-length 300 amino acid protein, was the predominant transcript in T/T homozygotes, while transcript D, which encodes the prematurely truncated protein, was the predominant transcript in TA/TA homozygotes. In human liver biopsy tissue, the truncated isoform D protein was minimally present in heterozygotes and TA/TA homozygotes, and isoform A protein abundance was reduced in an allele dosage-dependent manner (see FIGS. 10B and 10C). These data are consistent with HSD17B13 rs72613567 altering mRNA splicing, resulting in the synthesis of a truncated form of the protein with substantially reduced expression in human liver.

Referring to FIGS. 10A-10E, expression, subcellular localization, and enzymatic activity of a novel HSD17B13 transcript is shown. Expression of HSD17B13 transcripts A and D in homozygous reference (T/T), heterozygous (T/TA), and homozygous alternate (TA/TA) carriers of the HSD17B13 rs72613567 splice variant is shown in FIGS. 3A and 3D. Coding regions in gene models are indicated in the striped boxes and untranslated regions in the black boxes. The asterisk in transcript D indicates the insertion of G from rs72613567 at the 3' end of exon 6, which leads to premature truncation of the protein. mRNA expression is displayed in FPKM units (Fragments Per Kilobase of transcript per Million mapped reads). A Western blot from HepG2 cells overexpressing HSD17B13 transcripts A and D shows that HSD17B13 transcript D was translated to a truncated protein with lower molecular weight compared to HSD17B13 transcript A (see FIG. 10A). Similar results were observed with an HSD17B13 western blot from fresh frozen human liver and HEK293 cell samples (see FIG. 10B). Human liver samples were from homozygous reference (T/T), heterozygous (T/TA), and homozygous alternate (TA/TA) carriers of the HSD17B13 rs72613567 splice variant. Cell samples were from HEK293 cells overexpressing non-tagged HSD17B13 transcripts A and D. HSD17B13 Transcript D was translated to a truncated protein IsoD with lower molecular weight than HSD17B13 IsoA. HSD17B13 IsoD protein levels were lower than IsoA protein levels from both human liver (left) and cell (right) samples (see FIG. 10C). Protein level normalized to actin is shown in the bar columns in FIG. 10C; ** P<0.001, *P<0.05. Both HSD17B13 Isoforms A and D were localized on lipid droplet membrane in HepG2 stably overexpressing HSD17B13 transcripts A or D were labelled with BODIPY to show lipid droplets and anti-Myc to show HSD17B13 localization (data not shown). Enzymatic activity of HSD17B13 isoforms A and D to 17-beta estradiol (estradiol), leukotriene B4 (LTB4), and 13-Hydroxyoctadecadienoic acid (13(S)-HODE) was also assessed (see FIG. 10D). HSD17B13 Isoform D showed <10% enzymatic activity of the corresponding values for Isoform A. HSD17B13 Isoform D when overexpressed in HEK293 cells did not show much conversion of estradiol (substrate) to estrone (product) when measured in the culture media, while overexpressed HSD17B13 Isoform A showed robust conversion (see FIG. 10E).

HSD17B13 is expressed primarily in the liver (Liu et al., *Acta Biochim. Pol.,* 2007, 54, 213-8, herein incorporated by reference in its entirety for all purposes), where it localizes to lipid droplets (Su et al., *Proc. Natl. Acad. Sci. USA,* 2014, 111, 11437-42, herein incorporated by reference in its entirety for all purposes), consistent with a role in the pathogenesis of fatty liver disease. The expression of HSD171B3 and its localization was evaluated in an immortalized human liver cell line stably transduced with lentivirus expressing HSD17B13 Transcripts A and D. HSD17B13 Isoform A was mainly detected on membranes surrounding BODIPY-labeled lipid droplets (data not shown). Similar subcellular localization was observed for HSD17B13 Isoform D at the lipid droplet surface (see FIG. 10D).

To understand the functional consequences of premature truncation of HSD17B13 protein due to rs72613567:TA, the enzymatic activity of Isoforms A and D was evaluated in vitro using recombinant protein. Greater than 300 putative substrates were examined, of which estradiol, leukotriene B4, and 13-Hydroxyoctadecadienoic acid were enzymatically converted by HSD17B13, resulting in oxidation of a hydroxyl to a ketone group. HSD17B13 Isoform D showed greatly reduced activity towards the three substrates (see FIG. 10D).

Figure 10A:
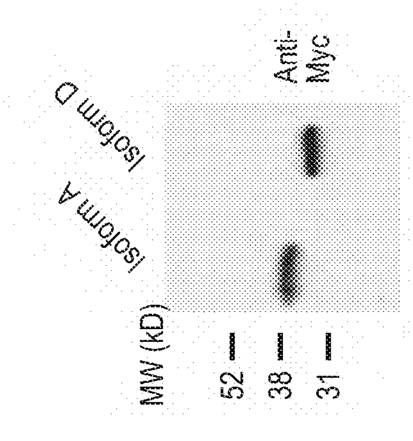
FIGS. 10A-10E show expression, subcellular localization, and enzymatic activity of a novel HSD17B13 transcript.
Figure 10B:
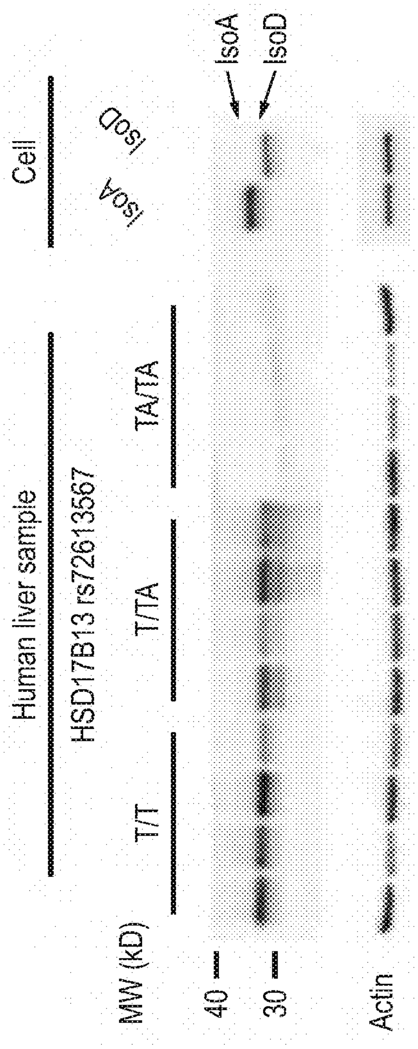
Figure 10C:
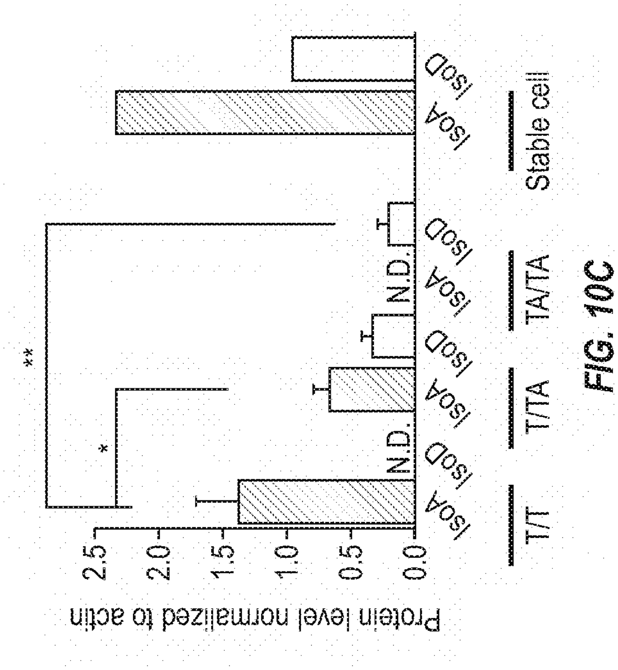
Figure 10E:
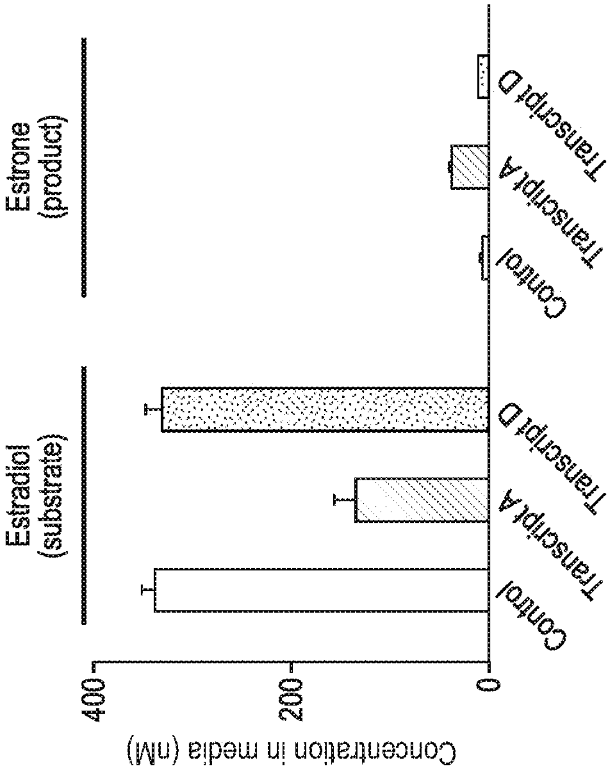
Figure 10D:
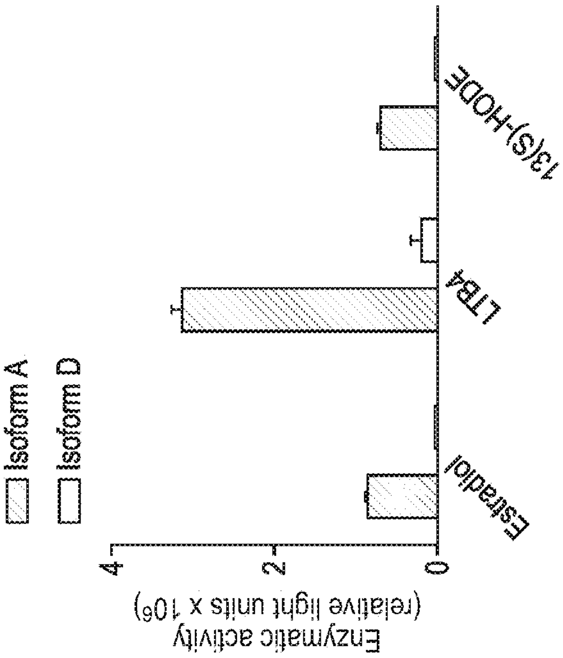
Figure 11C:
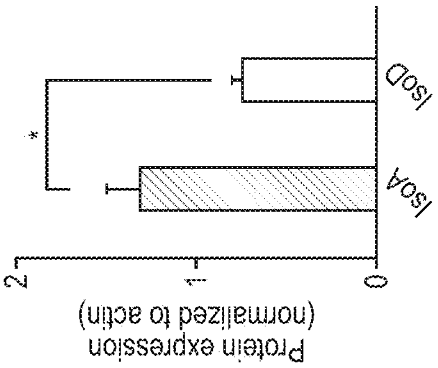
FIGS. 11A-11C show that HSD17B13 Isoform D protein has lower molecular weight and is unstable when overexpressed in HEK 293 cells.
Figure 11B:
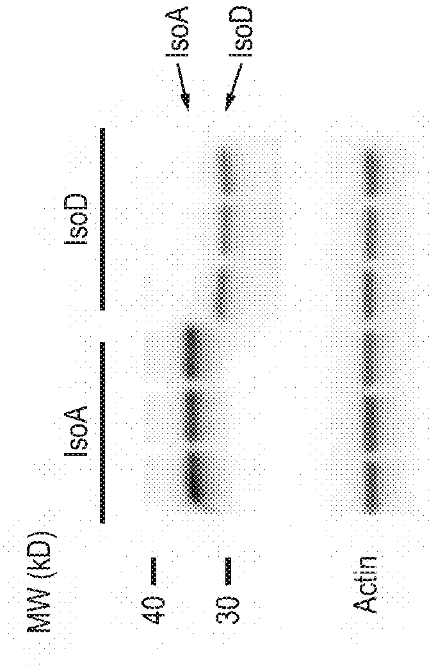
Figure 11A:
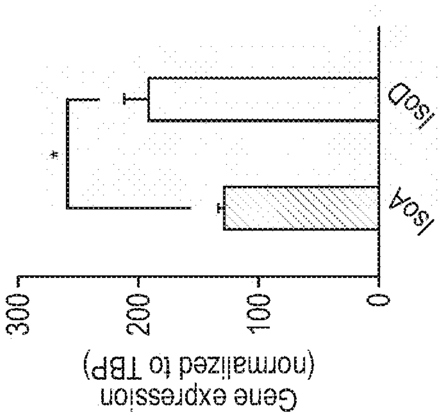

Compared to GFP control, HSD17B 1 3-Transcript-A-overexpressing cells had lower concentration of estradiol as well as higher concentration of estrone in the cell culture medium, suggesting enzyme activity against estradiol (see FIG. 10E). HSD17B13-Transcript-D-overexpressing cells had similar ratio of estrone/estradiol to GFP control cells, suggesting that HSD17B13 Transcript D has significant loss of function. The mass spectrometry analysis revealed rapid conversion of estrone into hydroxyestrone and other products accounting for the low accumulation of estrone compared to consumed estradiol.

Through large-scale exome sequencing, a novel association was identified between a splice variant in HSD17B13 and decreased serum transaminase levels, as well as reduced risk of nonalcoholic and alcoholic forms of liver disease, including advanced cirrhotic forms of liver disease and HCC. To our knowledge, this is the first report of a protein-altering variant that has a protective association with liver disease. The HSD17B13 rs72613567:TA allele was not associated with simple steatosis, but reduced the risk of progression to NASH. The consistency of the dosage-dependent protective associations in four independent cohorts (DiscovEHR, an independent bariatric surgery cohort in DiscovEHR, DLS, and DPLS) across several different liver disease categories and ethnicities support the notion that the reported HSD17B13 variant protects from progression to more clinically advanced stages of chronic liver disease. The observed allele dosage-dependence also argues that more profound regulation of HSD17B13 function may result in more profound effects on disease risk and progression.

The association findings described herein were primarily based on observations in European and Hispanic Americans who have elevated BMI. HSD17B13 is in close proximity with HSD17B11, a member of the same gene family with high sequence similarity to HSD17B13 but broader tissue distribution. Overall, the data presented herein support the position that HSD17B13 is a potential therapeutic target for prevention and treatment of fatty liver disease in humans. The data presented herein indicate that targeting of HSD17B13 could reduce progression of liver disease from steatosis to later stages of NASH, fibrosis, and cirrhosis, which are associated with significant morbidity and mortality, and for which there are currently no effective treatments.

Example 3. Variant 17Beta-Hydroxysteroid Dehydrogenase 13 Protects Against Chronic Liver Disease To identify genetic factors contributing to chronic liver disease, we utilized exome sequence data and electronic health records from 46,544 participants in the DiscovEHR human genetics study. We identified genetic variants associated with established biomarkers of hepatic injury (serum alanine aminotransferase (ALT) and aspartate aminotransferase (AST)) to nominate candidates that might be associated with chronic liver disease. Candidate variants replicating in three additional cohorts (12,527 individuals) were subsequently evaluated for association with clinical diagnoses of chronic liver disease in DiscovEHR and two independent cohorts (total of 37,892 individuals). We also examined the association with histopathological severity of liver disease in an independent bariatric surgery cohort (n=2,391 human liver samples).

A splice variant (rs72613567:TA) in HSD17B13, encoding the hepatic lipid droplet protein 17-beta hydroxysteroid dehydrogenase 13, was reproducibly associated with reduced ALT ($P=4.2\times10^{-12}$) and AST ($P=6.2\times10^{-10}$) levels. In DiscovEHR, this variant was associated with reduced risk of alcoholic and nonalcoholic liver disease (by 38%, 95% confidence interval (CI) 19%-52%; and by 16%, 95% CI 9%-22%, respectively, for each rs72613567:TA allele) and cirrhosis (by 44%, 95% CI 22-59%; and by 26%, 95% CI 12%-38% for alcoholic and nonalcoholic cirrhosis, respectively, for each rs72613567:TA allele) in an allele dosage-dependent manner; associations were confirmed in two independent cohorts. rs72613567:TA was associated with decreased severity of histological features of nonalcoholic steatohepatitis (NASH) (23% reduction, 95% CI 10%-34% for each rs72613567:TA allele among individuals with fatty liver disease). rs72613567:TA results in an unstable and truncated protein with reduced enzymatic activity against steroid substrates.

A loss-of-function variant in HSD17B13 was associated with reduced risk of alcoholic and nonalcoholic liver disease, and progression from steatosis to NASH.

Study Design and Participants

Human genetics studies were conducted as part of the DiscovEHR collaboration of the Regeneron Genetics Center and Geisinger Health System (GHS). The two DiscovEHR study populations (discovery cohort and bariatric surgery cohort) originated from the first 50,726 consented participants ≥18 years of age from the MyCode® Community Health Initiative of GHS. The GHS discovery cohort consisted of 46,544 European individuals recruited from outpatient primary care and specialty clinics between 2007 and 2016, excluding all those recruited to the bariatric surgery cohort. The GHS bariatric surgery cohort consisted of 2,644 European individuals who had been referred for bariatric surgery.

Replication studies of associations with liver transaminases included 1,357 European individuals from the Dallas Heart Study and 8,527 European individuals from the Penn Medicine Biobank. The Dallas Heart Study is a probability-based population cohort study of Dallas County residents aged 30 to 65 years (Victor et al., *Am. J Cardiol.,* 2004; 93, 1473-80, herein incorporated by reference in its entirety for all purposes). The Penn Medicine Biobank includes participants recruited from the University of Pennsylvania Health System and consented for biospecimen storage, access to EHR data, and permission to recontact.

Replication studies of the associations with chronic liver disease included 517 individuals from the Dallas Liver Study (DLS) and 447 individuals from the Dallas Pediatric Liver Study (DPLS). The DLS is a biobank of patients with liver disease of non-viral etiology. Recruitment began in January 2015 and is ongoing. Participants were recruited from liver clinics at UT Southwestern and Parkland Health and Hospital System, Dallas. Participants completed a questionnaire on ethnic/racial background, medical history, lifestyle factors, and family history of liver disease and other diseases. Additional clinical information was extracted from medical records by a trained technician. We included all African American, European American, and Hispanic American patients with DNA available at the time of the present study (n=517) with controls from the Dallas Heart Study. The DPLS is a biobank of Hispanic children recruited from pediatric liver clinics at UT Southwestern and Parkland Health and Hospital System, Dallas, and from an obesity clinic at Children's Medical Center, Dallas. Clinical information was extracted from medical records by a trained technician. As more than 95% of the patients were Hispanic Americans, we only included Hispanic American patients and controls in the present study (n=205 patients and 234 controls).

Clinical Measurements and Chronic Liver Disease Definitions in the Discovery Cohort Clinical laboratory measurements for ALT and AST were extracted from EHRs of participants from the GHS discovery cohort and bariatric surgery cohort. Median ALT and AST values were calculated for all participants with two or more measurements, and were $\log_{10}$-transformed to normalize the distribution prior to association analyses.

International Classification of Diseases, Ninth Revision (ICD-9) disease diagnosis codes were extracted from EHRs and collapsed into clinical disease categories for non-viral, nonalcoholic (ICD-9 571.40, 571.41, 571.49, 571.5, 571.8, 571.9) or alcoholic (CD-9 571.0, 571.1, 571.2, 571.3) liver disease case definitions. Additional case definitions based on single diagnosis codes included: alcoholic cirrhosis (ICD-9 571.2), nonalcoholic cirrhosis (CD-9 571.5), and HCC (ICD-9 155.0). For these case definitions, a common control group without liver disease ("no liver disease") was defined as participants with no case criteria or single-encounter or problem-list diagnosis code indicating any type of liver disease.

Liver Histopathologic Phenotype Definitions in the Bariatric Surgery Cohort

The GHS bariatric surgery cohort consisted of 2,644 individuals of European descent. Wedge biopsies of the liver were obtained intraoperatively during bariatric surgery from 2,391 of these individuals. The biopsies were consistently obtained 10 cm to the left of falciform ligament prior to any liver retraction or surgery on the stomach. The biopsy was divided into sections, with the primary section delivered to the clinical pathologists for liver histology (fixed in 10% neutral buffered formalin and stained with hematoxylin and eosin for routine histology and Masson's trichrome for assessment of fibrosis) and remaining sections stored within a research biobank (frozen in RNAlater and/or liquid nitrogen). Liver histology was conducted by an experienced pathologist and subsequently re-reviewed by a second experienced pathologist using the NASH Clinical Research Network scoring system (Kleiner et al., *Hepatology,* 2005, 41, 1313-21, herein incorporated by reference in its entirety for all purposes) as follows: steatosis grade 0 (<5% parenchymal involvement), 1 (5 to <33%), 2 (34 to <66%), and 3 (>67%); lobular inflammation grade 0 (no foci), grade 1 (mild, <2 foci per 200× field), grade 2 (moderate, 2-4 foci per 200× field), grade 3 (severe, >4 foci per 200× field); fibrosis Stage 0 (none), Stage 1 (perisinusoidal or periportal fibrosis), Stage 2 (perisinusoidal and periportal fibrosis), Stage 3 (bridging fibrosis), and Stage 4 (cirrhosis). These histologic diagnoses were used to defined the following phenotypes: 1) Normal: no evidence of steatosis, NASH, or fibrosis; 2) Simple steatosis: Steatosis (regardless of grade) with no evidence of NASH or fibrosis; 3) NASH: Any presence of lobular inflammation or hepatocyte ballooning (regardless of grade), or any presence of fibrosis (regardless of stage); 4) Fibrosis: Any presence of fibrosis (regardless of stage).

Sample Preparation, Sequencing, and Genotyping

DNA sample preparation and whole exome sequencing for the participants in the DiscovEHR study, the Dallas Heart Study, and the Penn Medicine Biobank were performed at the Regeneron Genetics (Dewey et al., *Science* In Press, 2016, herein incorporated by reference in its entirety for all purposes). HSD17B13 rs72613567 was genotyped by Taqman assay (and verified by Sanger sequencing in 5 individuals of each genotype) in the Dallas Liver Study and Dallas Pediatric Liver Study.

In particular, exome capture was performed using NimbleGen probes according to the manufacturer's recommended protocol (Roche NimbleGen). The captured DNA was PCR amplified and quantified by qRT-PCR (Kapa Biosystems). The multiplexed samples were sequenced using 75 bp paired-end sequencing on an Illumina v4 HiSeq 2500 to a coverage depth sufficient to provide greater than 20× haploid read depth of over 85% of targeted bases in 96% of samples (approximately 80× mean haploid read depth of targeted bases). Raw sequence data from each Illumina Hiseq 2500 run were uploaded to the DNAnexus platform (Reid et al., *BMC Bioinformatics,* 2014, 15, 30, herein incorporated by reference in its entirety for all purposes) for sequence read alignment and variant identification. In brief, raw sequence data were converted from BCL files to sample-specific FASTQ-files, which were aligned to the human reference build GRCh37.p13 with BWA-mem (Li et al., *Bioinformatics,* 2009, 25, 1754-60, herein incorporated by reference in its entirety for all purposes). Single nucleotide variants (SNV) and insertion/deletion (indel) sequence variants were identified using the Genome Analysis Toolkit (McKenna et al., *Genome Res.,* 2010, 20, 1297-303, herein incorporated by reference in its entirety for all purposes).

Exome-Wide Association Analysis of Liver Enzymes and Chronic Liver Disease Phenotypes We used linear mixed models to test 502,219 biallelic variants that had missing data rate of <1%, Hardy-Weinberg equilibrium P-value $>1.0\times10^{-6}$, and minor allele frequency >0.1% for association with transaminase levels. For variants with exome wide significant associations with transaminases ($p<1\times10^{-7}$) in the GHS discovery cohort, we performed association analyses and meta-analysis, in the European-ancestry replication studies described above. We used a Bonferroni significance threshold determined by the number of variants tested to define replicated associations. Meta-analysis of discovery and replication studies was also performed. All P-values reported in the text correspond to the allelic model.

We subsequently tested transaminase-associated single nucleotide variants for associations with chronic liver disease phenotypes. We used a Bonferroni significance threshold determined by the number of variants and broad chronic liver disease categories tested to determine significance of associations. We further tested replicated novel variants for association with histopathologically defined liver phenotypes from the GHS bariatric surgery cohort. We also performed a phenome-wide study of associations of replicated novel variants with 405 quantitative clinical measurements and 3,168 clinical diagnoses.

In particular, we tested 502,219 biallelic variants with missing data rate <1%, Hardy-Weinberg equilibrium P-value $>1.0\times10^{-6}$, and minor allele frequency >0.1% for association with transaminase levels. $\text{Log}_{10}$-transformed median ALT and AST were adjusted for age, age$^2$, sex, BMI, and the first four principal components of ancestry. To account for relatedness among study participants, we also fit a genetic relatedness matrix as a random-effects covariate. Both principal components and the genetic relatedness matrix were constructed from 39,858 non-MHC markers in approximate linkage equilibrium and with minor allele frequency >0.1%. We used linear mixed models as implemented in the GCTA package (Yang et al., *Am. J. Hum. Genet.,* 2011, 88, 76-82, herein incorporated by reference in its entirety for all purposes) to test for association between trait residuals and single nucleotide variants. All P-values reported in the text correspond to the allelic model.

We attempted to replicate associations in the GHS discovery cohort in three separate European-ancestry cohorts: the GHS bariatric surgery cohort, the Dallas Heart Study, and the Penn Medicine Biobank (described above). ALT and AST measures from the GHS bariatric surgery cohort and from Penn Medicine Biobank were $\log_{10}$-transformed and adjusted for age, age$^2$, sex, BMI, and the first four principal components of ancestry. Genetic relatedness matrices were included as random-effects covariates, and analysis was performed using linear mixed models in GCTA. In the Dallas Heart study, $\log_{10}$-transformed ALT and AST measures were adjusted for age, age$^2$, sex, BMI, and the first ten principal components of ancestry, and analysis was performed using linear regression implemented in PLINK. Summary statistics for the three replication cohorts were meta-analyzed using METAL (Willer et al., Bioinformatics, 2010, 26, 2190-1, herein incorporated by reference in its entirety for all purposes) (replication meta-analysis). Summary statistics for the discovery cohort and the three replication cohorts were meta-analyzed similarly (joint meta-analysis).

Association Analysis with Chronic Liver Disease Phenotypes

We analyzed thirteen significant and replicated single nucleotide variants from the liver enzyme ExWAS for associations with chronic liver disease phenotypes defined from the GHS discovery cohort, as described above. We used a Bonferroni significance threshold of $P<0.05/26$ ($P<1.92\times10^{-3}$) to account for the thirteen variants and two broad chronic liver disease categories (alcoholic and non-alcoholic) tested. The HSD17B13 rs72613567 variant was further tested for association with histopathologically defined liver phenotypes from the GHS bariatric surgery cohort, as described above. Odds ratios were estimated with the use of Firth's penalized likelihood method of logistic regression after adjustment for age, age$^2$, sex, BMI, and the first four principal components of ancestry. Genotypic odds ratios were estimated for HSD17B13 rs72613567 using the same covariates.

Odds ratios for liver disease in the DLS were estimated by logistic regression, adjusted for age, age$^2$, sex, body mass index, and self-reported ethnicity. Participants from the Dallas Heart Study with available rs72613567 genotypes were used as normal controls (n=4,279). Odds ratios in the DPLS were estimated by logistic regression.

Phenone-Wide Association Study of HSD17B13 rs72613567

We performed a phenome-wide study of associations of HSD17B13 rs72613567 with 405 quantitative EHR-derived anthropometric, vital sign, laboratory, electrocardiographic, echocardiographic, and bone densitometry measurements, and also with 3,168 EHR-derived clinical diagnoses. Median laboratory values for individuals with serial outpatient measures were calculated following removal of likely spurious values that were >3 standard deviations from the intra-individual median value; maximum and minimum values were also calculated. We then calculated trait residuals for all laboratory traits after adjustment for age, age$^2$, sex, and the first ten principal components of ancestry, and applied appropriate transformations prior to association analysis. ICD-9 based diagnosis codes were collapsed to hierarchical clinical disease groups and corresponding controls using a modified version of the groupings proposed by Denny et al (Denny et al., *Mature Biotechnology,* 2013, 31, 1102-10 and Denny et al., Bioinformatics, 2010, 26, 1205-10, each of which is herein incorporated by reference in its entirety for all purposes). ICD-9 based diagnoses required one or more of the following: a problem list entry of the diagnosis code or an encounter diagnosis code entered for two separate clinical encounters on separate calendar days.

Analyses of association with transformed quantitative clinical measurement residuals were performed using linear regression, and analyses of association with clinical diagnoses were performed using logistic regression adjusted for age, age$^2$, sex, and the first four principal components. Alleles were coded using both additive (0 for reference allele homozygotes, 1 for heterozygotes, and 2 for alternative allele homozygotes) and recessive (0 for reference allele homozygotes and heterozygotes, 1 for alternative allele homozygotes) models.

Software

Genetic association analyses were performed using GCTA software, version 1.25.07 and PLINK, version 1.9.0. Quantile-quantile and Manhattan plots were generated using R software, version 3.2.1 (R Project for Statistical Computing). Regional association plots were generated using LocusZoom (Pruim et al., *Bioinformmatics,* 2010, 26, 2336-7, herein incorporated by reference in its entirety for all purposes).

RNA Sequencing Studies

RNA quality and concentration was evaluated by running total RNA on an Agilent RNA Nano Bioanalyzer chip, all samples had an RNA integrity number (RIN) greater than 8. Polyadenlylated RNA transcripts were isolated using two rounds of enrichment with oligo(dT)25 beads (Thermo Fisher Scientific). Samples were purified and concentrated with RNAclean XP beads (Beckman Coulter) and heat-fragmented to approximately 140 base pairs. First-strand synthesis was completed with SuperScript III reverse transcriptase (Thermo Fisher Scientific) using random hexamers; dTTP was replaced with dUTP during second-strand synthesis. Samples were processed according to our standard DNA library preparation method referenced above for exomes with the addition of a uracil DNA-glycosylase step to generate strand-specific sequencing libraries.

Identification and Validation of Novel HSD17B13 Transcripts

Reads were mapped to the Human.B38 using ArrayStudio® software (OmicSoft®, Cary, NC) allowing two mismatches. Two approaches were employed to identify novel HSD17B13 transcripts. Novel exon junctions were discovered based on Gencode v24 using ArrayStudio. lie novo transcript assembly was carried out using Trinity (v2.2.0) in default setting. Custom gene models were built to incorporate novel transcripts of HSD17B13, and transcript quantification was estimated by read alignment to the custom gene model. Protein sequence alignment of all identified HSD17B13 isoforms is shown in FIG. 7. RT-PCR was performed on total RNA from human liver samples was performed using the SuperScript™ One-Step RT-PCR System with Platinum™ Taq DNA Polymerase (Thermo Fisher). Each 50 μL RT-PCR reaction contained 1× Reaction Mix, 500 nM each forward and reverse primers (PST516: ATGAACATCATCCTAGAAATCCTTC (SEQ ID NO: 251) and PST517: ATCATGCATACATCTCTGGCTGGAG (SEQ ID NO: 252)), 1 μL of RT/Platinum Taq, and 75 ng RNA. Cycling conditions were: one cycle of 45 °C for 30 minutes; one cycle of 94 °C for 2 minutes; 40 cycles of 94 °C for 20 seconds, 53 °C for 30 seconds, and 72 °C for 90 seconds; one cycle of 72 °C for 5 minutes; then a 10 °C hold. Products were purified using the QIAquick PCR Purification Kit (Qiagen) and submitted for direct Sanger sequencing using the primer DE002 (ATCAGAACTTCAGGCCTTGG (SEQ ID NO: 253)). To identify the B and C transcripts, the RT-PCR products were run out on a 2% agarose gel stained with SYBR GoldSYBR® Gold Nucleic Acid Gel Stain (ThermoFisher), and bands of the expected molecular weight were excised and purified using the QIAquick Gel Extraction Kit (Qiagen), then subjected to cloning with the TOPO® TA Cloning Kit (ThermoFisher). Sequencing of the TOPO clones was performed using M13F and M13R sequencing primers. Sequence analysis was performed using the Sequencher DNA analysis software (Gene Codes Corporation). Full-length HSD17B13 transcripts were amplified directly from 50 ng of total RNA with the SuperScript III One-step RT-PCR System with Platinum Taq High Fidelity (ThermoFisher Scientific) using gene-specific primers in the first (GCAAAGCCATGAACATCATCC (SEQ ID NO: 254)) and last exons (TCTTGATGTAGTGGGAGTCG-GATT (SEQ ID NO: 255)) to generate an amplicon of about 2.2 kb (maximum predicted size transcript). Amplicons were verified on an Agilent Bioanalyzer. PacBio-compatible barcoded adapters were ligated to the amplicons and cleaned with PacBio PB beads (Pacific Biosciences). Libraries were pooled in equal amounts and sequenced on one SMRT cell for 180 minutes on the PacBio RSII platform. The data was demultiplexed using PacBio software smrtanalysis v2.3 tool labelzmw and then analyzed with ConsensusTools AmpliconAnalysis. Resulting amplicons were compared to HSD17B13 RefSeq genes to determine isoform and genotype status.

Subcellular Localization of HSD17B13 Isoforms

HepG2 cells were cultured in Eagle's Minimum Essential Medium supplemented with 10% fetal bovine serum. HSD17B13 transcripts A and D were sub-cloned into Myc-DDK backbone lentivirus constructs, and lentivirus were generated. HepG2 cells were infected with lentivirus carrying the HSD17B13 transcripts. Stable cell lines expressing each HSD17B13 transcript were selected with 1-3 mg/ml Geneticin G-418 sulfate in complete culture medium for two weeks. Following fixation, HSD17B13 isoforms were detected with mouse anti-Myc antibody. Lipid droplets were labeled with BODIPY FL dye (Sigma). Secondary antibodies for immunofluorescence were Alexa Fluor 488 donkey anti-rabbit IgG and Alexa Fluor 594 donkey anti-mouse IgG (Jackson ImmunoResearch).

Quantification of HSD171B3 Protein Expression in Hunan Liver Biopsy Tissue and Stable Cell Lines Human liver and cell pellet samples were homogenized in ice-cold 1× RIPA lysis buffer (EMD Millipore) in the presence of protease and phosphatase inhibitor mixtures (ThermoFisher). Supernatant was collected and used for protein concentration using BCA protein assay (ThermoFisher). Human tissue and cell lysates were loaded and separated on SDS/PAGE gels (Bio-Rad) and transferred to PVDF membranes (Bio-Rad). The membranes were blocked for 1 hour with 5% (wt/vol) milk in 1× TBS supplemented with 0.1% Tween20 (Bio-Rad). Membranes were incubated with antibody at 4 °C overnight against HSD17B13 (1:200, Thermo-Fisher) and B-Actin (1:500, Cell Signaling Technology). Bound antibody was detected using HRP-conjugated anti-rabbit antibody (1:10,000, Jackson ImmunoResearch) and enhanced using chemi-luminescence reagent (ThermoFisher). Band intensities were quantified using Image J software.

Real-Time Semi-Quantitative PCR

RNA was extracted from cell using TRIzol® (Invitrogen, Carlsbad, CA). First-strand cDNA was synthesized using Superscript III RT (Invitrogen) and utilized for Semi-Quantitative PCR based on intron-spanning primers. A QuantStudio 6 Flex Real-Time PCR System was used to measure the expression level of transcripts. Primers of HSD17B13 and TBP were ordered from IDT (Integrated DNA Technologies). Relative gene expression was analyzed with the ΔΔCt method, providing a fold-change of expression normalized to the house-keeping gene TBP (ΔCt).

Lipid Droplet isolation and Characterization by Western Blotting

Lipid droplets were prepared from HepG2 cells stably expressing HSD17B13 transcript A (IsoA) or transcript D (IsoD) as previously reported (Brasaemle D L, Wolins N E. Isolation of lipid droplets from cells by density gradient centrifugation. Current protocols in cell biology 2006; Chapter 3:Unit 3 15 and Ding et al., Nature Protocols, 2013, 8, 43-51, each of which is herein incorporated by reference in its entirety for all purposes). In brief, HepG2 cells stably expressing HSD17B13 IsoA, IsoD, or the parental line were incubated overnight with 1 mM oleic acid. The following lipid loading, cells were scraped and resuspended in hypotonic lysis buffer (20 mM Tris, pH 7.5, 1 mM EDTA) supplemented with 1× HaltTM protease/phosphatase inhibitors (Thermo) and lysed by cavitation at 50 bar for 8 minutes. Lysates were centrifuged at 1000 g/4 °C for 10 minutes, and the post-nuclear supernatant (PNS) was mixed with sucrose to a final volume of 2 mL and concentration of 20% in ultracentrifuge tubes. Then 1.5 mL of 5% sucrose and another 1.5 mL of hypotonic lysis buffer was layered on top of the lysate. Tubes were centrifuged at 182,000 g/4 °C for 40 minutes, and the lipid droplet (LD) layers were transferred to new tubes. The remaining volume in the tube was aspirated, and the pelleted (total membrane, TM) was resuspended in 0.5 mL hypotonic lysis buffer. The PNS, LD, and TM fractions were mixed with 1× radioimmunoprecipitation (RIPA) buffer (EMD)+ NuPAGE™ LDS Sample Buffer (Thermo) and β-mercaptoethanol and sonicated for 3 hours at 37 °C. The TM lysate was diluted 2.5-fold to normalize to the PNS. Lysates were run on 4-20% SDS-PAGE gels (Biorad), transferred using the Trans-Blot (Biorad) onto low fluorescence PVDF membranes, and blocked for 1 hour in Odyssey TBS Blocking Buffer. Membranes were incubated overnight with the following antibodies: a-HSD17B13 (Abgent, cat #AP5729a 1:500); LD marker: a-ADRP (Proteintech, 152-94-1-AP, 1:2500); LD marker: a-TIP47 (Proteintech, 10694 1:2000); lysosome marker: α-LAMP 1 (Novus, NBP2-25183, 1:1000); cytosolic marker: α-GAPDH (Proteintech, 60004-1-Ig, 1:2000); endoplasmic reticulum marker: α-calreticulin (Abcam, ab92516, 1:1000); mitochondrial marker: α-COX IV (Abcam, ab33985, 1:500); cytoskeleton marker: α-actin (Sigma, A5441, 1:4000). The next day membranes were washed 4 times with Tris-buffered saline+0.1% Tween, then incubated for 1 hour at room temperature with blocking buffer containing IRDye® α-rabbit (800CW) and α-mouse (680RD) secondary antibodies (Li-Cor) at 1:5,000 and 1:10,000 dilutions, respectively. Gels were washed again with TBST and imaged using the Odyssey.

Quantification of Intracellular Triglyceride Content

The triglyceride (TG) content from the stable cells was determined using a TG quantification kit (Abcam). In the assay, TG are converted to free fatty acids and glycerol. The glycerol is then oxidized to generate a product which is quantified (spectrophotometry at λ=570 nm).

Substrate Screening of Steroid and Bioactive Lipid Libraries Against Purified Recombinant HSD17B13

Reactions were performed in a final volume of 40 μL of assay buffer (0.2 M Tris-HCl, pH 7.5) which contained 500 μM $NAD^+$, 5 μM bioactive lipid or 50 μM steroid (all in a final concentration of 5% DMSO), and 100 ng recombinant human HSD17B13. Reactions were incubated for 3 hours, at 23 °C, after which an equal volume NADH-Glo Detection Reagent (Promega) was added. Following a 1 hour incubation at 23 °C, the relative light units (RLUs) were measured on an Envision Plate Reader (Perkin Elmer). Raw RLU values were normalized as percent of control (50 μM estradiol) following subtraction of negative control (5% DMSO) using the following formula: Percent of control (POC) =100×(Sample (RLU)−Negative CTRLaverage)/(Positive CTRLaverage−Negative CTRLaverage).

In Vitro and Cellular Characterization of HSD17B13 Enzymatic Activity

Recombinant human HSD17B13 protein was purified from *E. coli* (Genscript) transformed with plasmid DNA harboring HSD171313 transcript A or transcript D. The HSD17B13 variants contained a 10×His tag at the C terminus and were purified from soluble fraction using a $Ni2^+$ affinity purification. Enzymatic activity was determined through measurement of NADH production using the NAD (P)H-Glo Detection System (Promega). Reactions were performed for 3 hours at 25 °C in 0.2 M Tris-HCl, pH 7.5, 0.5 mM $NAD^+$, 75 μM of substrate (Sigma) and 500 ng purified enzyme in a final volume of 100 μL. After incubation, 20 μL of the reaction was combined with 20 μL luciferase reagent (Promega), incubated at room temperature for 1 hour and read on an Envision Plate Reader (Perkin Elmer).

HEK293 cells overexpressing HSD17B13 transcript A, transcript D or green fluorescent protein (GFP, control) were used to investigate the activity of HSD17B13 against estradiol in a cell-based assay. Estradiol (1 μM) was fed to each cell type. After 48 hours, the media was collected and the concentration of estradiol and its converted product estrone were identified and quantified by LC-MS.

Association of Exonic Variants with Aspartate and Alanine Aminotransferases

Figure 1B:
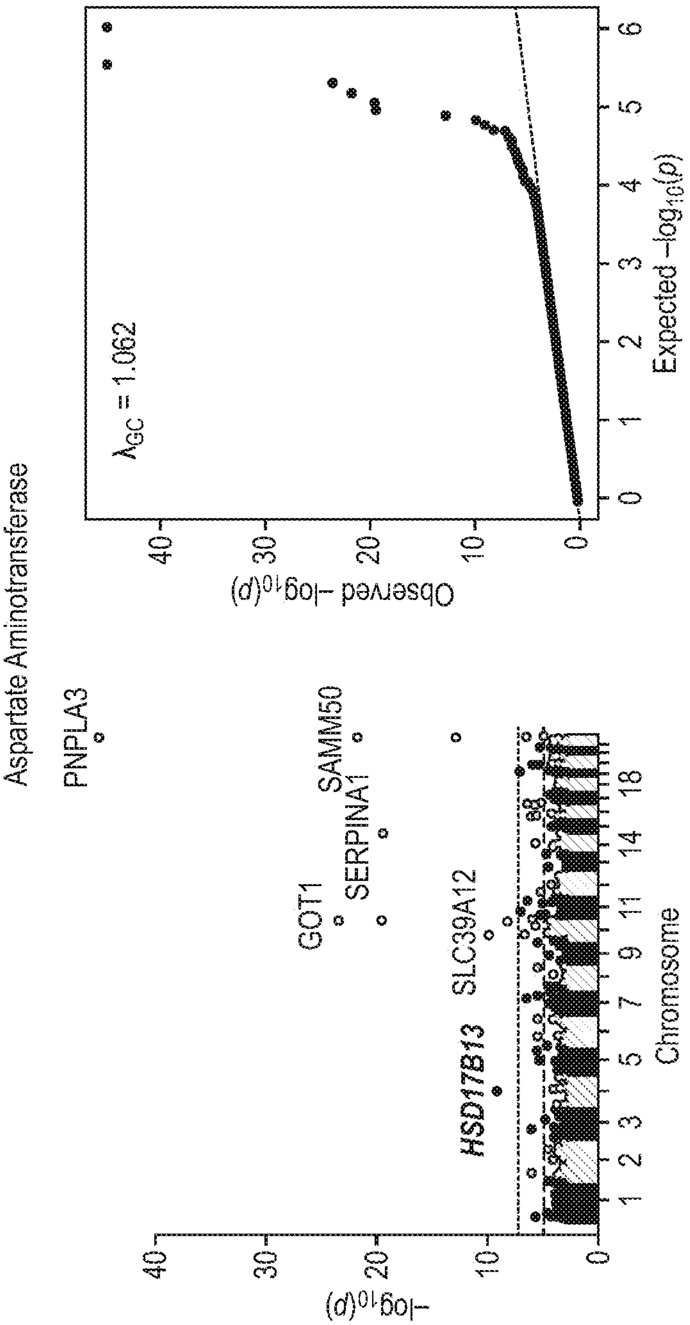

We tested 502,219 biallelic single genetic variants for association with serum ALT or AST levels in 46,544 individuals of European descent from the DiscovEHR study ("GHS discovery cohort"; basic demographics in Table 6). A total of 35 variants in 19 genes were found to be associated with ALT or AST at $P<1.0\times10^{-7}$ (FIGS. 1A and 1B, and Table 7). We performed replication studies in three cohorts of European-ancestry individuals: 1) bariatric surgery patients (n=2,644) from DiscovEHR ("GHS bariatric surgery cohort"); 2) 1,357 individuals from the Dallas Heart Study; and 3) 8,526 individuals from the Penn Medicine Biobank. In meta-analysis of the replication cohorts, thirteen variants in nine genes were significantly associated with serum levels of ALT or AST (Bonferroni significance threshold of $P<1.43\times10^{-3}$ for 35 variants tested, Table 8). These included variants that were previously reported to be associated with elevated transaminase levels, such as PNPLA37, TM6SF211, SERPINA122, SAMM5023, and ERLIN124. SERPINA1 encodes alpha-1-antitrypsin, whose functional deficiency causes liver disease; the association with SAMM50 is mediated via linkage disequilibrium with variation in PNPLA3, and ERLIN1 has been implicated in liver fat deposition. We also identified variants that were not previously reported to be associated with liver disease. These included several variants in GPT and GOT1, the genes encoding ALT and AST, respectively, and SLC39A12, which encodes solute carrier family 39 member 12.

We also identified a reproducible association between a variant in HSD17B13, the gene encoding hydroxysteroid 17-beta dehydrogenase 13, an uncharacterized member of the 17-beta hydroxysteroid dehydrogenase family, and decreased levels of ALT (discovery $P=4.2\times10^{12}$, replication $P=1.7\times10^{-4}$) and AST (discovery $P=6.2\times10^{10}$, replication $P=1.7\times10^{-4}$, Table 8). The associated variant, rs72613567, is an insertion of an adenine adjacent to the donor splice site of exon six (TA allele), and had an allele frequency of 26.0% in the GHS discovery cohort. Previously, Chambers et al. identified a nearby locus at 4q22 (rs6834314) associated with ALT levels (Chambers et al., *Nat. Genet.,* 2011, 43, 1131-1138, doi:10.1038/ng.970, herein incorporated by reference in its entirety for all purposes); rs72613567 has not heretofore been reported to be associated with transaminase levels. HSD17B13 is 30 kb upstream of HSD17B 11, another member of the same gene family. We did not observe exome-wide significant associations between coding or splice variants in HSD17B 11 and transaminase levels in the discovery cohort (FIGS. 5A and 5B) or in the joint meta-analysis of the discovery cohort and three replication cohorts. Furthermore, linkage disequilibrium of rs72613567 with variants in HSD17B11 was modest across all ancestry groups ($r^2<0.4$ with all ascertained variants in HSD17B11 in all ancestry groups). Collectively, these findings suggest HSD17B13 as the gene in the genomic region that is most likely to be functionally related to transaminase levels.

TABLE 6

Demographics and clinical characteristics of sequenced European-ancestry individuals from the discovery and replication cohorts.

| Characteristic | Discovery Cohort (N = 46,544) | Bariatric Surgery Cohort (N = 2,644) | Dallas Heart Study (N = 1,357) | Penn Medicine Biobank (N = 8,526) |
|---|---|---|---|---|
| Age (years)-median (IQR) | 62.9 (49.6-73.8) | 52.9 (44.1-61.2) | 46.0 (38.0-54.0) | 68.0 (60.0-76.0) |
| Female sex-number (%) | 26,875 (57.7) | 2,119 (80.1) | 724 (53.4) | 3,242 (38.0) |
| Body mass index-median (IQR) | 29.9 (35.4-44.8) | 47.4 (42.0-53.7) | 28 (25-32) | 30 (25-32) |
| Transaminase level (U/L)-median (IQR) | | | | |
| Alanine aminotransferase (ALT) | 22.0 (17.0-29.0) | 23.0 (17.5-29.5) | 20.0 (15.0-27.0) | 22.0(17.0-30.0) |
| Aspartate aminotransferase (AST) | 23.0 (20.0-27.5) | 23.0 (20.0-27.0) | 21.0 (18.0-25.0) | 24.0 (20.0-30.5) |

TABLE 6-continued

Demographics and clinical characteristics of sequenced European-ancestry individuals from the discovery and replication cohorts.

| Characteristic | Discovery Cohort (N = 46,544) | Bariatric Surgery Cohort (N = 2,644) | Dallas Heart Study (N = 1,357) | Penn Medicine Biobank (N = 8,526) |
|---|---|---|---|---|
| Presence of liver disease (by ICD-9 code)-N (%) | | | | |
| Alcoholic liver disease | 197 (0.4) | 7 (0.3) | — | — |
| Alcoholic cirrhosis | 130 (0.3) | 3 (0.1) | — | — |
| Nonalcoholic, non-viral liver disease | 1,938 (4.2) | 1,543 (58.4) | — | — |
| Nonalcoholic cirrhosis | 382 (0.8) | 24 (0.9) | — | — |
| Hepatocellular carcinoma | 76 (0.2) | 1 (0.04) | — | — |
| No liver disease | 30,628 (65.8) | 1 (0.04) | — | — |

TABLE 7

Single nucleotide variants associated with serum transaminase levels at $P < 1.0 \times 10^{-7}$ in the discovery cohort.

| Train | CHR | BP | REF | ALT | rsID | Gene | Annotation | AA Substitution | Beta (SE) |
|---|---|---|---|---|---|---|---|---|---|
| ALT | 1 | 220970028 | A | G | rs2642438 | MARC1 | missense | p.Thr165Ala | 0.008 (0.001) |
| | 4 | 88231392 | T | TA | *rs72613567 | HSD17B13 | splice donor | | -0.009 (0.001) |
| | 8 | 144997604 | C | T | rs371119003 | PLEC | missense | p.Ala2302Thr | -0.160 (0.026) |
| | 8 | 145008502 | G | A | | PLEC | missense | p.Arg522Cys | -0.268 (0.032) |
| | 8 | 145692918 | G | A | rs35968570 | KIFC2 | missense | p.Glu174Lys | -0.033 (0.005) |
| | 8 | 145730072 | G | A | rs143408057 | GPT | missense | p.Arg83His | -0.314 (0.036) |
| | 8 | 145730161 | C | T | rs201815297 | GPT | missense | p.Ala87Val | -0.224 (0.014) |
| | 8 | 145730221 | G | A | rsl 12574791 | GPT | missense | p.Arg107Lys | -0.033 (0.005) |
| | 8 | 145731636 | T | G | rs145155876 | GPT | stop gained | p.Tyr326* | -0.235 (0.031) |
| | 8 | 145732114 | G | C | rs141505249 | GPT | missense | p.Glu430Gln | -0.224 (0.013) |
| | 8 | 145732151 | G | A | rs143462595 | GPT | missense | p.Arg442His | -0.077 (0.013) |
| | 8 | 145732180 | G | C | rsl 47998249 | GPT | missense | p.Val452Leu | -0.225 (0.013) |
| | 8 | 145732305 | G | GC | | GPT | frameshift | p.Glu475fs | -0.271 (0.031) |
| | 8 | 145748532 | A | G | rs567402720 | LRRC24 | missense | p.Leu290Ser | -0.185 (0.028) |
| | 8 | 117122202 | C | T | rs3748177 | AKNA | synonymous | p.Glu755Glu | -0.007 (0.001) |
| | 9 | 117124731 | G | A | rs3748176 | AKNA | missense | p.Pro624Leu | -0.007 (0.001) |
| | 9 | 101595996 | T | A | rs 17222723 | ABCC2 | missense | p.Val1188Glu | -0.015 (0.003) |
| | 10 | 101606861 | G | T | rs1137968 | ABCC2 | synonymous | p.Val1430Val | -0.015 (0.003) |
| | 10 | 101610533 | C | T | rs8187707 | ABCC2 | synonymous | p.His1496His | -0.015 (0.003) |
| | 10 | 101611294 | G | A | rs8187710 | ABCC2 | missense | p.Cys1515Tyr | -0.015 (0.003) |
| | 10 | 101912064 | T | C | *rs2862954 | ERLINI | missense | p.Ile291Val | -0.012 (0.001) |
| | 10 | 101977883 | C | T | rs2230804 | CHUK | missense | p.Val268Ile | -0.009 (0.001) |
| | 10 | 113917085 | T | A | rs2254537 | GPAM | synonymous | p.Pro681Pro | -0.008 (0.001) |
| | 10 | 113940329 | T | C | rs2792751 | GPAM | missense | p.Ile43Val | -0.008 (0.001) |
| | 14 | 94844947 | C | T | *rs28929474 | SERPINAI | missense | p.Glu366Lys | 0.042 (0.005) |

TABLE 7-continued

Single nucleotide variants associated with serum transaminase levels at $P < 1.0 \times 10^{-7}$ in the discovery cohort.

| | | | | | | | | | |
|---|---|---|---|---|---|---|---|---|---|
| | 19 | 19379549 | C | T | *rs58542926 | TM6SF2 | missense | p.Glu167Lys | 0.014 (0.002) |
| | 22 | 44324727 | C | G | *rs738409 | PNPLA3 | missense | p.Ile148Met | 0.023 (0.002) |
| | 22 | 44324730 | C | T | *rs738408 | PNPLA3 | synonymous | p.Pro149Pro | 0.023 (0.002) |
| | 22 | 44342116 | A | G | rs2294918 | PNPLA3 | missense | p.Lys434Glu | 0.007 (0.001) |
| | 22 | 44368122 | A | G | *rs3761472 | SAMM50 | missense | p.Asp110Gly | 0.019 (0.002) |
| | 22 | 44395451 | T | C | *rs1007863 | PARVB | missense | p.Trp37Arg | 0.011 (0.001) |
| AST | 4 | 88231392 | T | TA | *rs72613567 | HSD17B13 | splice donor | | -0.005 (0.001) |
| | 10 | 18242311 | A | G | rs10764176 | SLC39A12 | missense | p.Ser36Gly | -0.006 (0.001) |
| | 10 | 101157378 | CGTT | C | | GOT1 | inframe indel | p.Asn389del | -0.221 (0.024) |
| | 10 | 101165533 | G | C | rs374966349 | GOT1 | missense | p.Gln208Glu | 0.271 (0.027) |
| | 10 | 101912064 | T | C | *rs2862954 | ERLIN1 | missense | p.Ile291Val | -0.005 (0.001) |
| | 11 | 22271870 | A | T | rs7481951 | ANO5 | missense | p.Leu322Phe | 0.004 (0.001) |
| | 14 | 94844947 | C | T | *rs28929474 | SERPINA1 | missense | p.Glu366Lys | 0.027 (0.003) |
| | 19 | 19379549 | C | T | *rs58542926 | TM6SF2 | missense | p.Glu167Lys | 0.008 (0.002) |
| | 22 | 44324727 | C | G | *rs738409 | PNPLA3 | missense | p.Ile148Met | 0.014 (0.001) |
| | 22 | 44324730 | C | T | *rs738408 | PNPLA3 | synonymous | p.Pro149Pro | 0.014 (0.001) |
| | 22 | 44368122 | A | G | *rs3761472 | SAMM50 | missense | p.Asp110Gly | 0.011 (0.001) |
| | 22 | 44395451 | T | C | *rs1007863 | PARVB | missense | p.Trp37Arg | 0.006 (0.001) |

| | | | | | | | | N | | | Mean AST or ALT level (U/L) | | |
|---|---|---|---|---|---|---|---|---|---|---|---|---|---|
| Train | CHR | BP | REF | ALT | p | AAF | N | REF/REF | REF/ALT | ALT/ALT | REF/REF | REF/ALT | ALT/ALT |
| ALT | 1 | 220970028 | A | G | 4.67E-08 | 0.7067 | 41,414 | 3,515 | 17,262 | 20,637 | 23.88 | 24.52 | 24.92 |
| | 4 | 88231392 | T | TA | 4.16E-12 | 0.2634 | 41,414 | 22,441 | 16,130 | 2,843 | 25.02 | 24.26 | 24.1 |
| | 8 | 144997604 | C | T | 1.30E-09 | 0.0005 | 41,413 | 41,373 | 40 | 0 | 24.67 | 18.1 | NA |
| | 8 | 145008502 | G | A | 3.26E-17 | 0.0003 | 41,414 | 41,387 | 27 | 0 | 24.67 | 13.8 | NA |
| | 8 | 145692918 | G | A | 1.40E-11 | 0.0139 | 41,414 | 40,271 | 1,133 | 10 | 24.67 | 12.07 | NA |
| | 8 | 145730072 | G | A | 3.28E-18 | 0.0003 | 41,414 | 41,393 | 21 | 0 | 24.67 | 12.07 | NA |
| | 8 | 145730161 | C | T | 6.28E-59 | 0.0018 | 41,414 | 41,270 | 144 | 0 | 24.7 | 14.68 | NA |
| | 8 | 145730221 | G | A | 4.25E-11 | 0.0136 | 41,414 | 40,293 | 1,111 | 10 | 24.71 | 23.09 | 18.35 |
| | 8 | 145731636 | T | G | 1.76E-14 | 0.0004 | 41,394 | 41,364 | 30 | 0 | 24.67 | 14.07 | NA |
| | 8 | 145732114 | G | C | 8.84E-64 | 0.0019 | 41,375 | 41,223 | 150 | 2 | 24.7 | 14.48 | 13.75 |
| | 8 | 145732151 | G | A | 1.18E-09 | 0.0021 | 41,406 | 41,232 | 174 | 0 | 24.68 | 20.87 | NA |
| | 8 | 145732180 | G | C | 8.19E-65 | 0.0019 | 41,413 | 41,254 | 159 | 0 | 24.7 | 14.74 | NA |
| | 8 | 145732305 | G | GC | 1.00E-18 | 0.0004 | 41,414 | 41,385 | 29 | 0 | 24.67 | 14.24 | NA |
| | 8 | 145748532 | A | G | 3.42E-11 | 0.0004 | 41,393 | 41,358 | 35 | 0 | 24.67 | 17.71 | NA |

TABLE 7-continued

Single nucleotide variants associated with serum transaminase levels at $P < 1.0 \times 10^{-7}$ in the discovery cohort.

| | | | | | | | | | | | | |
|---|---|---|---|---|---|---|---|---|---|---|---|---|
| | 8 | 117122202 | C | T | 9.51E-09 | 0.5232 | 41,414 | 9,414 | 20,645 | 11,355 | 25.12 | 24.72 | 24.18 |
| | 9 | 117124731 | G | A | 4.31E-09 | 0.5230 | 41,412 | 9,427 | 20,634 | 11,351 | 25.12 | 24.73 | 24.17 |
| | 9 | 101595996 | T | A | 2.97E-08 | 0.0608 | 41,414 | 36,543 | 4,704 | 167 | 24.77 | 23.97 | 22.12 |
| | 10 | 101606861 | G | T | 2.71E-08 | 0.0608 | 41,414 | 36,543 | 4,704 | 167 | 24.77 | 23.97 | 22.04 |
| | 10 | 101610533 | C | T | 2.77E-08 | 0.0608 | 41,414 | 36,542 | 4,706 | 166 | 24.77 | 23.97 | 22.03 |
| | 10 | 101611294 | G | A | 2.15E-08 | 0.0611 | 41,414 | 36,519 | 4,726 | 169 | 24.77 | 23.97 | 21.99 |
| | 10 | 101912064 | T | C | 2.43E-21 | 0.4755 | 41,414 | 11,318 | 20,819 | 9,277 | 25.32 | 24.71 | 23.77 |
| | 10 | 101977883 | C | T | 1.93E-13 | 0.5072 | 41,414 | 10,048 | 20,733 | 10,633 | 25.18 | 24.75 | 24.01 |
| | 10 | 113917085 | T | A | 4.61E-10 | 0.7073 | 41,414 | 3,627 | 16,984 | 20,803 | 25 | 24.97 | 24.36 |
| | 10 | 113940329 | T | C | 2.54E-10 | 0.7097 | 41,412 | 3,567 | 16,910 | 20,935 | 25 | 24.98 | 24.35 |
| | 14 | 94844947 | C | T | 9.28E-21 | 0.0171 | 41,414 | 40,006 | 1,399 | 9 | 24.58 | 26.91 | 43.89 |
| | 19 | 19379549 | C | T | 4.76E-09 | 0.0759 | 41,413 | 35,388 | 5,780 | 245 | 24.52 | 25.46 | 26.84 |
| | 22 | 44324727 | C | G | 1.34E-50 | 0.2351 | 41,414 | 24,257 | 14,837 | 2,320 | 24.06 | 24.99 | 28.91 |
| | 22 | 44324730 | C | T | 1.11E-50 | 0.2349 | 41,414 | 24,273 | 14,824 | 2,317 | 24.06 | 24.98 | 28.92 |
| | 22 | 44342116 | A | G | 8.26E-08 | 0.5986 | 41,412 | 6,691 | 19,833 | 14,888 | 24.15 | 24.47 | 25.15 |
| | 22 | 44368122 | A | G | 8.85E-30 | 0.1682 | 41,413 | 28,626 | 11,618 | 1,169 | 24.23 | 25.36 | 28.45 |
| | 22 | 44395451 | T | C | 7.98E-16 | 0.3963 | 41,414 | 15,036 | 19,920 | 6,458 | 24.15 | 24.6 | 26.09 |
| AST | 4 | 88231392 | T | TA | 6.24E-10 | 0.2638 | 40,753 | 22,068 | 15,870 | 2,815 | 24.47 | 24.1 | 23.96 |
| | 10 | 18242311 | A | G | 1.09E-10 | 0.2881 | 40,753 | 20,645 | 16,738 | 3,370 | 24.47 | 24.15 | 23.85 |
| | 10 | 101157378 | CGTT | C | 1.96E-20 | 0.0002 | 40,753 | 40,733 | 20 | 0 | 24.29 | 14.7 | NA |
| | 10 | 101165533 | G | C | 2.43E-24 | 0.0002 | 40,753 | 40,736 | 17 | 0 | 24.28 | 44.5 | NA |
| | 10 | 101912064 | T | C | 4.82E-09 | 0.4754 | 40,753 | 11,138 | 20,486 | 9,129 | 24.59 | 24.26 | 23.99 |
| | 11 | 22271870 | A | T | 9.61E-08 | 0.5833 | 40,722 | 7,123 | 19,686 | 13,913 | 24.03 | 24.22 | 24.53 |
| | 14 | 94844947 | C | T | 2.44E-20 | 0.0172 | 40,753 | 39,361 | 1,384 | 8 | 24.24 | 25.76 | 34.5 |
| | 19 | 19379549 | C | T | 6.54E-08 | 0.0760 | 40,752 | 34,811 | 5,698 | 243 | 24.21 | 24.74 | 25.43 |
| | 22 | 44324727 | C | G | 8.31E-46 | 0.2343 | 40,753 | 23,889 | 14,622 | 2,242 | 23.96 | 24.48 | 26.62 |
| | 22 | 44324730 | C | T | 8.93E-46 | 0.2341 | 40,753 | 23,905 | 14,609 | 2,239 | 23.96 | 24.47 | 26.63 |
| | 22 | 44368122 | A | G | 1.22E-22 | 0.1680 | 40,752 | 28,170 | 11,450 | 1,132 | 24.07 | 24.64 | 26.24 |
| | 22 | 44395451 | T | C | 1.31E-13 | 0.3961 | 40,753 | 14,761 | 19,678 | 6,314 | 24.02 | 24.23 | 25.1 |

*Indicates variants having exome-wide significant associations with both ALT and AST.

Abbreviations:

AAF, alternate allele frequency;

Alt, alternate allele;

ALT, alanine aminotransferase;

AST, aspartate aminotransferase;

Ref, reference allele;

SE, standard error.

TABLE 8

Replication and joint meta-analysis of 35 exome-wide significant single nucleotide variants from the discovery cohort in three separate European-ancestry cohorts.

| | | | | | | | | | GHS Discovery Cohort | | |
|---|---|---|---|---|---|---|---|---|---|---|---|
| Train | Chr | BP | Ref | Alt | RSID | Gene | Ann | AA Sub-stitution | Beta (SE) | P | N |
| ALT | 1 | 220970028 | A | G | rs2642438 | MARC1 | mis | p.Thr165Ala | 0.008 (0.001) | 4.67E-08 | 41,414 |
| | 4 | 88231392 | T | TA | rs72613567 | HSD17B13 | spl | | -0.009 (0.001) | 4.16E-12 | 41,414 |
| | 8 | 144997604 | C | T | rs371119003 | PLEC | mis | p.Ala2302Thr | -0.160 (0.026) | 1.30E-09 | 41,413 |
| | 8 | 145008502 | G | A | | PLEC | mis | p.Arg522Cys | -0.268 (0.032) | 3.26E-17 | 41,414 |
| | 8 | 145692918 | G | A | rs35968570 | KIFC2 | mis | p.Glu174Lys | -0.033 (0.005) | 1.40E-11 | 41,414 |
| | 8 | 145730072 | G | A | rs143408057 | GPT | mis | p.Arg83His | -0.314 (0.036) | 3.28E-18 | 41,414 |
| | 8 | 145730161 | C | T | rs201815297 | GPT | mis | p.Ala87Val | -0.224 (0.014) | 6.28E-59 | 41,414 |
| | 8 | 145730221 | G | A | rs112574791 | GPT | mis | p.Arg107Lys | -0.033 (0.005) | 4.25E-11 | 41,414 |
| | 8 | 145731636 | T | G | rs145155876 | GPT | stop | p.Tyr326* | -0.235 (0.031) | 1.76E-14 | 41,394 |
| | 8 | 145732114 | G | C | rs141505249 | GPT | mis | p.Glu430Gln | -0.224 (0.013) | 8.84E-64 | 41,375 |
| | 8 | 145732151 | G | A | rs143462595 | GPT | mis | p.Arg442His | -0.077 (0.013) | 1.18E-09 | 41,406 |
| | 8 | 145732180 | G | C | rs147998249 | GPT | mis | p.Val452Leu | -0.225 (0.013) | 8.19E-65 | 41,413 |
| | 8 | 145732305 | G | GC | | GPT | fs | p.Glu475fs | -0.271 (0.031) | 1.00E-18 | 41,414 |
| | 8 | 145748532 | A | G | rs567402720 | LRRC24 | mis | p.Leu290Ser | -0.185 (0.028) | 3.42E-11 | 41,393 |
| | 9 | 117122202 | C | T | rs3748177 | AKNA | syn | p.Glu755Glu | -0.007 (0.001) | 9.51E-09 | 41,414 |
| | 9 | 117124731 | G | A | rs3748176 | AKNA | mis | p.Pro624Leu | -0.007 (0.001) | 4.31E-09 | 41,412 |
| | 10 | 101595996 | T | A | rs17222723 | ABCC2 | mis | p.Val1188Glu | -0.015 (0.003) | 2.97E-08 | 41,414 |
| | 10 | 101606861 | G | T | rs1137968 | ABCC2 | syn | p.Val1430Val | -0.015 (0.003) | 2.71E-08 | 41,414 |
| | 10 | 101610533 | C | T | rs8187707 | ABCC2 | syn | p.His1496His | -0.015 (0.003) | 2.77E-08 | 41,414 |
| | 10 | 101611294 | G | A | rs8187710 | ABCC2 | mis | p.Cys1515Tyr | -0.015 (0.003) | 2.15E-08 | 41,414 |
| | 10 | 101912064 | T | C | rs2862954 | ERLINI | mis | p.Ile291Val | -0.012 (0.001) | 2.43E-21 | 40,834 |
| | 10 | 101977883 | C | T | rs2230804 | CHUK | mis | p.Val268Ile | -0.009 (0.001) | 1.93E-13 | 41,414 |
| | 10 | 113917085 | T | A | rs2254537 | GPAM | syn | p.Pro681Pro | -0.008 (0.001) | 4.61E-10 | 41,414 |
| | 10 | 113940329 | T | C | rs2792751 | GPAM | mis | p.Ile43Val | -0.008 (0.001) | 2.54E-10 | 41,412 |

TABLE 8-continued

Replication and joint meta-analysis of 35 exome-wide significant single nucleotide variants from the discovery cohort in three separate European-ancestry cohorts.

| | | | | | | | | | | | |
|---|---|---|---|---|---|---|---|---|---|---|---|
| | 14 | 94844947 | C | T | rs28929474 | SERPINA1 | mis | p.Glu366Lys | 0.042 (0.005) | 9.28E-21 | 41,414 |
| | 19 | 19379549 | C | T | rs58542926 | TM6SF2 | mis | p.Glu167Lys | 0.014 (0.002) | 4.76E-09 | 41,413 |
| | 22 | 44324727 | C | G | rs738409 | PNPLA3 | mis | p.Ile148Met | 0.023 (0.002) | 1.34E-50 | 41,414 |
| | 22 | 44324730 | C | T | rs738408 | PNPLA3 | syn | p.Pro149Pro | 0.023 (0.002) | 1.11E-50 | 41,414 |
| | 22 | 44342116 | A | G | rs2294918 | PNPLA3 | mis | p.Lys434Glu | 0.007 (0.001) | 8.26E-08 | 41,412 |
| | 22 | 44368122 | A | G | rs3761472 | SAMM50 | mis | p.Asp110Gly | 0.019 (0.002) | 8.85E-30 | 41,413 |
| | 22 | 44395451 | T | V | rs 1007863 | PARVB | mis | p.Trp37Arg | 0.011 (0.001) | 7.98E-16 | 41,414 |
| AST | 4 | 88231392 | T | TA | rs72613567 | HSD17B13 | spl | | -0.005 (0.001) | 6.24E-10 | 40,753 |
| | 10 | 18242311 | A | G | rs10764176 | SLC39A12 | mis | p.Ser36Gly | -0.006 (0.001) | 1.09E-10 | 40,753 |
| | 10 | 101157378 | CG TT | C | | GOT1 | inf | p.Asn389del | -0.221 (0.024) | 1.96E-20 | 40,753 |
| | 10 | 101165533 | G | C | rs374966349 | GOT1 | mis | p.Gln208Glu | 0.271 (0.027) | 2.43E-24 | 40,753 |
| | 10 | 101912064 | T | C | rs2862954 | ERLIN1 | mis | p.Ile291Val | -0.005 (0.001) | 4.82E-09 | 40,753 |
| | 11 | 22271870 | A | T | rs7481951 | ANO5 | mis | p.Leu322Phe | 0.004 (0.001) | 9.61E-08 | 40,722 |
| | 14 | 94844947 | C | T | rs28929474 | SERPINA1 | mis | p.Glu366Lys | 0.027 (0.003) | 2.44E-20 | 40,753 |
| | 19 | 19379549 | C | T | rs58542926 | TM6SF2 | mis | p.Glu167Lys | 0.008 (0.002) | 6.54E-08 | 40,192 |
| | 22 | 44324727 | C | G | rs738409 | PNPLA3 | mis | p.Ile148Met | 0.014 (0.001) | 8.31E-46 | 40,753 |
| | 22 | 44324730 | C | T | rs738408 | PNPLA3 | syn | p.Pro149Pro | 0.014 (0.001) | 8.93E-46 | 40,753 |
| | 22 | 44368122 | A | G | rs3761472 | SAMM50 | mis | p.Asp110Gly | 0.011 (0.001) | 1.22E-22 | 40,752 |
| | 22 | 44395451 | T | C | rs1007863 | PARVB | Mis | p.Trp37Arg | 0.006 (0.001) | 1.31E-13 | 40,753 |

| | | | GHS Bariatric Surgery Cohort | | | Dallas Heart Study | | | U. Penn | | |
|---|---|---|---|---|---|---|---|---|---|---|---|
| Trait | CHR | BP | Beta (SE) | P | N | Beta (SE) | P | N | Beta (SE) | P | N |
| ALT | 1 | 220970028 | 0.005 (0.005) | 3.10E-01 | 2475 | 0.011 (0.008) | 1.76E-01 | 1357 | 0.007 (0.004) | 1.02E-01 | 6158 |
| | 4 | 88231392 | -0.010 (0.005) | 5.57E-02 | 2475 | -0.016 (0.008) | 6.60E-02 | 1357 | -0.013 (0.004) | 1.33E-03 | 6158 |
| | 8 | 144997604 | -0.492 (0.165) | 2.84E-03 | 2475 | NA (NA) | NA | NA | -0.051 (0.072) | 4.79E-01 | 6158 |
| | 8 | 145008502 | -0.161 (0.165) | 3.29E-01 | 2475 | NA (NA) | NA | NA | -0.247 (0.143) | 8.48E-02 | 6158 |

TABLE 8-continued

Replication and joint meta-analysis of 35 exome-wide significant single nucleotide variants from the discovery cohort in three separate European-ancestry cohorts.

| | | | | | | | | | | |
|---|---|---|---|---|---|---|---|---|---|---|
| 8 | 145692918 | -0.009 (0.020) | 6.48E-01 | 2475 | 0.032 (0.036) | 3.76E-01 | 1356 | -0.053 (0.018) | 3.72E-03 | 6158 |
| 8 | 145730072 | -0.189 (0.165) | 2.50E-01 | 2475 | NA (NA) | NA | NA | -0.298 (0.101) | 3.26E-03 | 6158 |
| 8 | 145730161 | -0.341 (0.074) | 3.64E-06 | 2475 | NA (NA) | NA | NA | -0.143 (0.054) | 8.50E-03 | 6158 |
| 8 | 145730221 | -0.009 (0.020) | 6.45E-01 | 2475 | 0.028 (0.036) | 4.37E-01 | 1357 | -0.060 (0.018) | 5.60E-04 | 6158 |
| 8 | 145731636 | -0.314 (0.165) | 5.71E-02 | 2475 | -0.317 (0.140) | 2.35E-02 | 1356 | -0.148 (0.143) | 3.04E-01 | 6157 |
| 8 | 145732114 | -0.273 (0.048) | 9.83E-09 | 2474 | -0.240 (0.075) | 1.36E-03 | 1357 | -0.197 (0.041) | 1.31E-06 | 6157 |
| 8 | 145732151 | -0.115 (0.058) | 4.82E-02 | 2475 | -0.106 (0.099) | 2.86E-01 | 1356 | -0.049 (0.041) | 2.27E-01 | 6157 |
| 8 | 145732180 | -0.273 (0.050) | 4.26E-08 | 2475 | -0.191 (0.070) | 6.58E-03 | 1357 | -0.197 (0.041) | 1.31E-06 | 6158 |
| 8 | 145732305 | -0.161 (0.165) | 3.29E-01 | 2475 | NA (NA) | NA | NA | -0.509 (0.203) | 1.21E-02 | 6158 |
| 8 | 145748532 | -0.161 (0.165) | 3.29E-01 | 2475 | NA (NA) | NA | NA | -0.307 (0.143) | 3.21E-02 | 6158 |
| 9 | 117122202 | -0.004 (0.005) | 4.09E-01 | 2475 | 0.004 (0.008) | 6.18E-01 | 1357 | -0.007 (0.004) | 5.29E-02 | 6158 |
| 9 | 117124731 | -0.004 (0.005) | 3.90E-01 | 2475 | 0.003 (0.008) | 7.33E-01 | 1356 | -0.007 (0.004) | 4.24E-02 | 6158 |
| 10 | 101595996 | -0.002 (0.010) | 8.01E-01 | 2475 | -0.007 (0.017) | 6.88E-01 | 1357 | -0.017 (0.007) | 1.55E-02 | 6158 |
| 10 | 101606861 | -0.003 (0.010) | 7.74E-01 | 2475 | -0.008 (0.017) | 6.28E-01 | 1357 | -0.017 (0.007) | 1.70E-02 | 6158 |
| 10 | 101610533 | -0.003 (0.010) | 7.93E-01 | 2475 | -0.008 (0.017) | 6.28E-01 | 1357 | -0.017 (0.007) | 1.76E-02 | 6158 |
| 10 | 101611294 | -0.001 (0.010) | 9.11E-01 | 2475 | -0.010 (0.017) | 5.40E-01 | 1357 | -0.016 (0.007) | 2.77E-02 | 6158 |
| 10 | 101912064 | -0.010 (0.005) | 2.91E-02 | 2475 | -0.006 (0.007) | 4.02E-01 | 1356 | -0.009 (0.004) | 2.06E-02 | 6158 |
| 10 | 101977883 | -0.006 (0.005) | 2.05E-01 | 2475 | 0.0001 (0.008) | 9.94E-01 | 1357 | -0.011 (0.004) | 3.91E-03 | 6158 |
| 10 | 113917085 | -0.003 (0.005) | 5.80E-01 | 2475 | -0.013 (0.008) | 1.15E-01 | 1357 | -0.008 (0.004) | 5.12E-02 | 6158 |
| 10 | 113940329 | -0.003 (0.005) | 5.61E-01 | 2475 | -0.013 (0.008) | 1.33E-01 | 1357 | -0.008 (0.004) | 4.77E-02 | 6158 |
| 14 | 94844947 | 0.035 (0.020) | 7.97E-02 | 2475 | 0.034 (0.032) | 2.92E-01 | 1357 | 0.054 (0.013) | 1.63E-05 | 6158 |
| 19 | 19379549 | 0.040 (0.010) | 2.40E-05 | 2475 | 0.024 (0.014) | 9.50E-02 | 1357 | 0.013 (0.008) | 7.51E-02 | 6158 |
| 22 | 44324727 | 0.019 (0.006) | 5.54E-04 | 2475 | 0.006 (0.009) | 5.43E-01 | 1357 | 0.016 (0.004) | 2.05E-04 | 6158 |
| 22 | 44324730 | 0.019 (0.006) | 5.51E-04 | 2475 | 0.006 (0.009) | 5.43E-01 | 1357 | 0.016 (0.004) | 2.14E-04 | 6158 |
| 22 | 44342116 | 0.001 (0.005) | 7.77E-01 | 2475 | 0.005 (0.008) | 5.18E-01 | 1357 | 0.005 (0.004) | 2.16E-01 | 6158 |

TABLE 8-continued

Replication and joint meta-analysis of 35 exome-wide significant single nucleotide variants from the discovery cohort in three separate European-ancestry cohorts.

| | | | | | | | | | | | |
|---|---|---|---|---|---|---|---|---|---|---|---|
| | 22 | 44368122 | 0.009 (0.006) | 1.66E-01 | 2475 | -0.001 (0.01) | 9.37E-01 | 1357 | 0.018 (0.005) | 4.02E-04 | 6158 |
| | 22 | 44395451 | 0.003 (0.005) | 5.22E-01 | 2475 | 0.008 (0.008) | 3.13E-01 | 1357 | 0.009 (0.004) | 2.50E-02 | 6158 |
| AST | 4 | 88231392 | -0.010 (0.003) | 3.12E-03 | 2469 | -0.012 (0.006) | 5.32E-02 | 1357 | -0.007 (0.004) | 5.56E-02 | 6166 |
| | 10 | 18242311 | -0.010 (0.003) | 2.91E-03 | 2469 | -0.003 (0.006) | 5.80E-01 | 1357 | -0.009 (0.004) | 1.03E-02 | 6166 |
| | 10 | 101157378 | -0.205 (0.062) | 8.57E-04 | 2469 | NA (NA) | NA | NA | -0.243 (0.088) | 5.97E-03 | 6165 |
| | 10 | 101165533 | NA (NA) | NA | NA | NA (NA) | NA | NA | 0.339 (0.079) | 1.85E-05 | 6166 |
| | 10 | 101912064 | -0.004 (0.003) | 1.54E-01 | 2469 | -0.007 (0.006) | 2.21E-01 | 1357 | -0.004 (0.003) | 1.94E-01 | 6166 |
| | 11 | 22271870 | -0.001 (0.003) | 7.85E-01 | 2466 | 0.006 (0.006) | 2.85E-01 | 1357 | -0.002 (0.003) | 5.46E-01 | 6165 |
| | 14 | 94844947 | 0.023 (0.013) | 7.79E-02 | 2469 | 0.044 (0.024) | 6.98E-02 | 1357 | 0.055 (0.011) | 4.01E-07 | 6166 |
| | 19 | 19379549 | 0.023 (0.006) | 1.99E-04 | 2469 | 0.010 (0.011) | 3.42E-01 | 1356 | 0.004 (0.007) | 5.94E-01 | 6166 |
| | 22 | 44324727 | 0.014 (0.004) | 1.27E-04 | 2469 | 0.004 (0.007) | 5.44E-01 | 1357 | 0.015 (0.004) | 4.87E-05 | 6166 |
| | 22 | 44324730 | 0.014 (0.004) | 1.32E-04 | 2469 | 0.004 (0.007) | 5.44E-01 | 1357 | 0.015 (0.004) | 4.96E-05 | 6166 |
| | 22 | 44368122 | 0.008 (0.004) | 6.03E-02 | 2469 | -0.001 (0.008) | 9.45E-01 | 1357 | 0.016 (0.004) | 2.64E-04 | 6166 |
| | 22 | 44395451 | 0.003 (0.003) | 4.12E-01 | 2469 | 0.006 (0.006) | 2.95E-01 | 1357 | 0.009 (0.003) | 6.17E-03 | 6166 |

| | | | **Replication Meta-Analysis (N=3) | | ***Joint Meta-Analysis (N = 4) | |
|---|---|---|---|---|---|---|
| Trait | Chr | BP | Beta (SE) | P | Beta (SE) | P |
| ALT | 1 | 220970028 | 0.007 (0.003) | 2.31E-02 | 0.008 (0.001) | 3.38E-09 |
| | 4 | 88231392 | -0.013 (0.003) | *3.85E-05 | -0.010 (0.001) | 1.17E-15 |
| | 8 | 144997604 | -0.121 (0.066) | 6.56E-02 | -0.155 (0.025) | 2.68E-10 |
| | 8 | 145008502 | -0.210 (0.108) | 5.23E-02 | -0.264 (0.031) | 5.54E-18 |
| | 8 | 145692918 | -0.025 (0.013) | 4.69E-02 | -0.032 (0.005) | 2.25E-12 |
| | 8 | 145730072 | -0.268 (0.086) | 1.88E-03 | -0.308 (0.033) | 2.79E-20 |
| | 8 | 145730161 | -0.213 (0.044) | *1.14E-06 | -0.223 (0.013) | 4.49E-64 |
| | 8 | 145730221 | -0.031 (0.013) | 1.36E-02 | -0.033 (0.005) | 1.92E-12 |
| | 8 | 145731636 | -0.256 (0.086) | 2.79E-03 | -0.237 (0.029) | 1.94E-16 |

TABLE 8-continued

Replication and joint meta-analysis of 35 exome-wide significant single nucleotide variants from the discovery cohort in three separate European-ancestry cohorts.

| | | | | | | |
|---|---|---|---|---|---|---|
| | 8 | 145732114 | −0.231 (0.029) | *7.24E−16 | −0.225 (0.012) | 6.06E−78 |
| | 8 | 145732151 | −0.074 (0.032) | 1.88E−02 | −0.076 (0.012) | 7.03E−11 |
| | 8 | 145732180 | −0.221 (0.029) | *1.41E−14 | −0.224 (0.012) | 1.04E−77 |
| | 8 | 145732305 | −0.299 (0.128) | 1.93E−02 | −0.273 (0.030) | 6.44E−20 |
| | 8 | 145748532 | −0.244 (0.108) | 2.40E−02 | −0.189 (0.027) | 2.93E−12 |
| | 9 | 117122202 | −0.005 (0.003) | 8.42E−02 | −0.007 (0.001) | 3.08E−09 |
| | 9 | 117124731 | −0.005 (0.003) | 6.15E−02 | −0.007 (0.001) | 1.00E−09 |
| | 10 | 101595996 | −0.012 (0.005) | 3.43E−02 | −0.014 (0.002) | 3.44E−09 |
| | 10 | 101606861 | −0.012 (0.005) | 3.25E−02 | −0.014 (0.002) | 2.99E−09 |
| | 10 | 101610533 | −0.012 (0.005) | 3.43E−02 | −0.014 (0.002) | 3.23E−09 |
| | 10 | 101611294 | −0.011 (0.005) | 5.21E−02 | −0.014 (0.002) | 4.09E−09 |
| | 10 | 101912064 | −0.009 (0.003) | *1.14E−03 | −0.011 (0.001) | 1.76E−23 |
| | 10 | 101977883 | −0.008 (0.003) | 4.33E−03 | −0.009 (0.001) | 3.59E−15 |
| | 10 | 113917085 | −0.007 (0.003) | 2.07E−02 | −0.008 (0.001) | 3.28E−11 |
| | 10 | 113940329 | −0.007 (0.003) | 2.00E−02 | −0.008 (0.001) | 1.77E−11 |
| | 14 | 94844947 | 0.047 (0.010) | *2.82E−06 | 0.043 (0.004) | 1.59E−25 |
| | 19 | 19379549 | 0.024 (0.006) | *1.37E−05 | 0.016 (0.002) | 1.15E−12 |
| | 22 | 44324727 | 0.016 (0.003) | *7.45E−07 | 0.021 (0.001) | 3.55E−55 |
| | 22 | 44324730 | 0.016 (0.003) | *7.73E−07 | 0.021 (0.001) | 3.10E−55 |
| | 22 | 44342116 | 0.004 (0.003) | 1.91E−01 | 0.006 (0.001) | 6.24E−08 |
| | 22 | 44368122 | 0.012 (0.004) | *7.69E−04 | 0.018 (0.002) | 1.08E−31 |
| | 22 | 44395451 | 0.007 (0.003) | 1.78E−02 | 0.010 (0.001) | 1.16E−16 |
| AST | 4 | 88231392 | −0.009 (0.002) | *8.38E−05 | −0.006 (0.001) | 6.82E−13 |
| | 10 | 18242311 | −0.009 (0.002) | *1.16E−04 | −0.006 (0.001) | 1.10E−13 |
| | 10 | 101157378 | −0.218 (0.051) | *1.66E−05 | −0.220 (0.022) | 1.68E−24 |

TABLE 8-continued

Replication and joint meta-analysis of 35 exome-wide significant single nucleotide variants from the discovery cohort in three separate European-ancestry cohorts.

| | | | | | |
|---|---|---|---|---|---|
| 10 | 101165533 | 0.339 (0.079) | *1.85E-05 | 0.278 (0.025) | 3.25E-28 |
| 10 | 101912064 | -0.005 (0.002) | 2.51E-02 | -0.005 (0.001) | 3.68E-10 |
| 11 | 22271870 | 0.000 (0.002) | 8.43E-01 | 0.004 (0.001) | 1.13E-06 |
| 14 | 94844947 | 0.042 (0.008) | *9.54E-08 | 0.029 (0.003) | 6.71E-26 |
| 19 | 19379549 | 0.014 (0.004) | *1.20E-03 | 0.009 (0.002) | 5.92E-10 |
| 22 | 44324727 | 0.013 (0.002) | *5.51E-08 | 0.014 (0.001) | 3.14E-52 |
| 22 | 44324730 | 0.013 (0.002) | *5.81E-08 | 0.014 (0.001) | 3.55E-52 |
| 22 | 44368122 | 0.010 (0.003) | *3.40E-04 | 0.011 (0.001) | 1.91E-25 |
| 22 | 44395451 | 0.006 (0.002) | 7.34E-03 | 0.006 (0.001) | 3.62E-15 |

*Indicates P-values meeting the Bonferroni significance threshold of P < 1.43 x 10-3.

**Replication meta-analysis includes the three replication cohorts: GHS Bariatric Surgery Cohort, Dallas Heart Study, and Penn Medicine Biobank.

***Joint meta-analysis includes the discovery cohort and the three replication cohorts: GHS Discovery Cohort, GHS Bariatric Surgery Cohort, Dallas Heart Study, and Penn Medicine Biobank.

Abbreviations:

AAF, alternate allele frequency;
Alt, alternate allele;
ALT, alanine aminotransferase;
AST, aspartate aminotransferase;
Ref, reference allele;
SE, standard error;
ann, annotation;
mis, missense;
syn, synonymous;
spl, splice donor;
stop, stop gained;
fs, frameshift;
inf, inframe indel.

Association of Exonic Variants with Clinical Diagnoses of Chronic Liver Disease

Next, we analyzed the relationship between the thirteen transaminase-associated variants in the nine genes found in the discovery and replication cohorts and chronic liver disease, including alcoholic and nonalcoholic (non-viral) liver disease, as well as the most advanced forms of chronic liver disease: alcoholic cirrhosis, nonalcoholic cirrhosis, and hepatocellular carcinoma (HCC). Using a Bonferroni significance threshold of $P<1.92\times10^{-3}$; for the thirteen variants tested, we found significant associations between six variants in five genes (HSD17B13, SERPINA1, TM6SF2, PNPLA3, and SAMM50) and chronic liver disease phenotypes (Table 9). The SERPINA 1, TM6SF2, PNPLA3, and SAMM50 associations confirm previously reported associations. In the discovery cohort, HSD17B13 rs72613567;TA was associated with lower odds of all EHR-derived categories of both alcoholic and nonalcoholic liver disease in an allele dosage-dependent manner (FIG. 2A): all categories of alcoholic liver disease, heterozygous odds ratio ($OR_{het}$) (95% confidence interval) 0.58 (0.42-0.80), homozygous OR ($OR_{hom}$) 0.47 (0.23-0.97), allelic OR ($OR_{allelic}$) 0.62 (0.48-0.81), $P=1.8\times10^{-4}$; all categories of nonalcoholic liver disease, $OR_{het}$, 0.83 (0.75-0.92), $OR_{hom}$ 0.70 (0.57-0.87), $OR_{allelic}$ 0.84 (0.78-0.91), $P=1.3\times10^{-5}$ HSD17B13 rs72613567:TA was also associated with lower odds of alcoholic and nonalcoholic cirrhosis, with 42% and 73% lower odds of alcoholic cirrhosis for heterozygotes and homozygotes, respectively, ($OR_{het}$ 0.58 (0.39-0.86), $OR_{hom}$ 0.27 (0.09-0.85), $OR_{allelic}$ 0.56 (0.41-0.78), $P=3.4\times10^{-4}$) and 26% and 49% lower odds of nonalcoholic cirrhosis for heterozygotes and homozygotes, respectively ($OR_{het}$ 0.74 (0.60-0.93), $OR_{hom}$ 0.51 (0.31-0.85), $OR_{allelic}$, 0.74 (0.62-0.88), $P=4.5\times10^{-4}$). HSD17B13 rs72613567:TA was also nominally associated with lower odds of HCC.

We sought to confirm and extend these findings in the multi-ethnic Dallas Liver Study (DLS) and the Dallas Pediatric Liver Study (DPLS, Table 10). In the DLS, the TA allele was associated with lower odds of any liver disease in an allele-dosage dependent manner ($OR_{het}$ 0.74 (0.57-0.97), $OR_{hom}$ 0.41 (0.21-0.83), $OR_{allelic}$ 0.70 (0.5-0.88), $P=1.8\times10^{-3}$, FIG. 8). Similar effects were observed across EHR-derived liver disease subtypes, including protective associations with advanced, cirrhotic forms of alcoholic ($OR_{allelic}$ 0.72 (0.53-0.99), $P=4.4\times10^{-2}$) and nonalcoholic ($OR_{allelic}$ 0.65 (0.40-1.07), $P=9.0\times10^{-2}$) liver disease. In subset analyses of individuals grouped by self-reported ethnicity, the association with liver disease was significant in Hispanic Americans (n=326 cases and 722 controls, $OR_{allelic}$. 0.51 (0.35-0.74), P=4.0×10'); similar numerical trends, which did not achieve statistical significance, were also noted in the African American (n=33 cases and 2,291 controls, $OR_{allelic}$ 0.74 (0.25-2.47), P=0.67) and European American (n=158 cases and 1,266 controls, $OR_{allelic}$ 0.87 (0.65-1.15), P0.32) subsets of the DLS. In the DPLS, a separate study of Hispanic American pediatric liver disease patients and obese controls, the TA allele was also associated with lower odds of liver disease ($OR_{allelic}$ 0.61 (0.37-0.99), P=4.6×$10^{-2}$). Thus, HSD17B13 rs72613567:TA was associated with reduced odds of multiple forms of chronic liver disease, including cirrhosis, in adults and children in three independent populations.

TABLE 9

Association of twelve exome-wide significant and replicating single nucleotide variants with liver disease phenotypes in the discovery cohort.

| | | | Alcoholic liver disease | | Alcoholic cirrhosis | |
|---|---|---|---|---|---|---|
| CHR:BP:Ref:Alt | Gene | rsID | OR (95% CI) | P-value | OR (95% CI) | P-value |
| 4:88231392:T:TA | HSD17B13 | rs72613567 | 0.62 (0.48-0.81) | *1.82E-04 | 0.56 (0.41-0.78) | *3.35E-04 |
| 8:145730161:C:T | GPT | rs201815297 | 3.83 (1.05-13.94) | 8.88E-02 | 6.33 (1.71-23.43) | 2.88E-02 |
| 8:145732114:G:C | GPT | rs141505249 | 0.77 (0.06-10.73) | 8.43E-01 | 1.13 (0.08-15.39) | 9.30E-01 |
| 8:145732180:G:C | GPT | rs147998249 | 0.73 (0.05-11.76) | 8.17E-01 | 1.07 (0.07-17.16) | 9.60E-01 |
| 10:18242311:A:G | SLC39A12 | rs10764176 | 0.85 (0.68-1.07) | 1.64E-01 | 0.92 (0.70-1.22) | 5.80E-01 |
| 10:101157378:CGTT:C | GOT1 | | 4.60 (0.25-86.41) | 3.93E-01 | 7.11 (0.38-133.19) | 3.00E-01 |
| 10:101165533:G:C | GOT1 | rs374966349 | 2.20 (0.13-37.68) | 6.24E-01 | 3.47 (0.20-59.04) | 4.70E-01 |
| 14:94844947:C:T | SERPINA1 | rs28929474 | 2.49 (1.49-4.17) | 2.30E-03 | 3.35 (1.93-5.83) | *3.01E-04 |
| 19:19379549:C:T | TM6SF2 | rs58542926 | 1.47 (1.06-2.04) | 2.76E-02 | 1.35 (0.89-2.04) | 1.80E-01 |
| 22:44324727:C:G | PNPLA3 | rs738409 | 1.76 (1.43-2.18) | *4.98E-07 | 2.07 (1.60-2.67) | *1.08E-07 |
| 22:44324730:C:T | PNPLA3 | rs738408 | 1.77 (1.43-2.18) | *4.70E-07 | 2.07 (1.61-2.67) | *1.03E-07 |
| 22:44368122:A:G | SAMM50 | rs3761472 | 1.90 (1.52-2.38) | *1.36E-07 | 2.28 (1.75-2.98) | *1.83E-08 |

| | | | Nonalcoholic liver disease | | Nonalcoholic cirrhosis | |
|---|---|---|---|---|---|---|
| CHR:BP:Ref:Alt | Gene | rsID | OR (95% CI) | P-value | OR (95% CI) | P-value |
| 4:88231392:T:TA | HSD17B13 | rs72613567 | 0.84 (0.78-0.91) | *1.31E-05 | 0.74 (0.62-0.88) | *4.48E-04 |
| 8:145730161:C:T | GPT | rs201815297 | 0.23 (0.04-1.14) | 1.86E-02 | 1.25 (0.24-6.38) | 7.98E-01 |
| 8:145732114:G:C | GPT | rs141505249 | 1.02 (0.49-2.11) | 9.70E-01 | 0.36 (0.02-5.37) | 3.82E-01 |
| 8:145732180:G:C | GPT | rs147998249 | 1.03 (0.49-2.17) | 9.30E-01 | 0.34 (0.02-5.59) | 3.67E-01 |
| 10:18242311:A:G | SLC39A12 | rs10764176 | 0.92 (0.86 (0.99) | 3.43E-02 | 1.03 (0.88-1.21) | 7.15E-01 |
| 10:101157378:CGTT:C | GOT1 | | 2.37 (0.61-9.27) | 2.50E-01 | 8.27 (1.44-47.49) | 5.92E-02 |

TABLE 9-continued

Association of twelve exome-wide significant and replicating single nucleotide variants with liver disease phenotypes in the discovery cohort.

| | | | | | | |
|---|---|---|---|---|---|---|
| 10:101165533:G:C | GOT1 | rs374966349 | 1.63 (0.53-4.96) | 4.20E-01 | 1.17 (0.07-20.09) | 9.13E-01 |
| 14:94844947:C:T | SERPINA1 | rs28929474 | 1.50 (1.21-1.87) | *5.29E-04 | 2.99 (2.11-4.24) | *9.08E-08 |
| 19:19379549:C:T | TM6SF2 | rs58542926 | 1.36 (1.21-1.52) | *2.42E-07 | 1.64 (1.31-2.05) | *6.04E-05 |
| 22:44324727:C:G | PNPLA3 | rs738409 | 1.65 (1.54-1.78) | *1.31E-41 | 2.05 (1.76-2.38) | *1.70E-19 |
| 22:44324730:C:T | PNPLA3 | rs738408 | 1.65 (1.54-1.78) | *1.42E-41 | 2.05 (1.77-2.38) | *1.45E-19 |
| 22:44368122:A:G | SAMM50 | rs3761472 | 1.52 (1.41-1.65) | *7.33E-24 | 1.86 (1.58-2.19) | *1.81E-12 |

| | | | Hepatocellular carcinoma | |
|---|---|---|---|---|
| CHR:BP:Ref:Alt | Gene | rsID | OR (95% CI) | P-value |
| 4:88231392:T:TA | HSD17B13 | rs72613567 | 0.67 (0.45-1.00) | 4.66E-02 |
| 8:145730161:C:T | GPT | rs201815297 | 3.66 (0.70-19.01) | 2.01E-01 |
| 8:145732114:G:C | GPT | rs141505249 | 1.84 (0.15-23.25) | 6.88E-01 |
| 8:145732180:G:C | GPT | rs147998249 | 1.74 (0.11-27.05) | 7.21E-01 |
| 10:18242311:A:G | SLC39A12 | rs10764176 | 1.29 (0.93-1.79) | 1.37E-01 |
| 10:101157378:CGTT:C | GOT1 | | 9.81 (0.52-183.54) | 2.43E-01 |
| 10:101165533:G:C | GOT1 | rs374966349 | 5.37 (0.32-91.12) | 3.55E-01 |
| 14:94844947:C:T | SERPINA1 | rs28929474 | 1.86 (0.74-4.67) | 2.40E-01 |
| 19:19379549:C:T | TM6SF2 | rs58542926 | 1.93 (1.22-3.04) | 1.08E-02 |
| 22:44324727:C:G | PNPLA3 | rs738409 | 2.20 (1.60-3.02) | *5.59E-06 |
| 22:44324730:C:T | PNPLA3 | rs738408 | 2.20 (1.60-3.03) | *5.41E-06 |
| 22:44368122:A:G | SAMM50 | rs3761472 | 1.66 (1.16-2.39) | 1.05E-02 |

*Indicates P-values meeting the Bonferroni significance threshold of $P < 2.08 \times 10^{-3}$.

TABLE 10

Demographics and clinical characteristics of genotyped multi-ethnic cases and controls from the Dallas Liver and Pediatric Liver Studies.

| Characteristic | Dallas Liver Study Cases (N = 517) | Dallas Liver Study Controls (N = 4,279) | Dallas Pediatric Liver Study Cases (N = 203) | Dallas Pediatric Liver Study Controls (N = 244) |
|---|---|---|---|---|
| Age (years)-median (IQR) | 55 (48-60) | 44 (36-53) | 12 (10-15) | 12 (11-14) |
| Female sex-number (%) | 277 (54) | 2,494 (58) | 65 (32) | 126 (52) |

TABLE 10-continued

Demographics and clinical characteristics of genotyped multi-ethnic cases and controls from the Dallas Liver and Pediatric Liver Studies.

| Characteristic | Dallas Liver Study Cases (N = 517) | Dallas Liver Study Controls (N = 4,279) | Dallas Pediatric Liver Study Cases (N = 203) | Dallas Pediatric Liver Study Controls (N = 244) |
|---|---|---|---|---|
| Body mass index-median (IQR) | 30 (27-35) | 30 (26-35) | 30 (27-34) | 31 (28-35) |
| Self-reported ethnicity | | | | |
| African American | 33 (6) | 2,291 (54) | — | — |
| European American | 158 (31) | 1,266 (30) | — | — |
| Hispanic American | 326 (63) | 722 (17) | 203 (100) | 244 (100) |
| Presence of liver disease (by ICD-9 code)-N (%) | | | | |
| Alcoholic liver disease | 223 (43) | — | — | — |
| Alcoholic cirrhosis | 215 (42) | — | — | — |
| Nonalcoholic, non-viral liver disease | 212 (20) | — | — | — |
| Nonalcoholic cirrhosis | 100 (19) | — | — | — |
| Hepatocellular carcinoma | 44 (9) | — | — | — |
| No liver disease | — | 4,279 (100) | — | -244 (100) |

Association of HSD17B13 rs72613567: TA with Liver Pathology

NAFLD describes a disease spectrum ranging from liver fat accumulation without evidence of significant inflammation (simple steatosis), to more clinically impactful NASH. To confirm the association between the HSD17B13 rs72613567:TA and ERR-derived liver disease diagnoses codes, and to further understand its association with histopathological progression of steatosis to NASH, we performed tests of association in the GHS bariatric surgery cohort. In this cohort of 2,391 of the whole exome sequenced individuals assessed by liver biopsy at the time of bariatric surgery, a total of 555 (23%) individuals had no evidence of steatosis, steatohepatitis, or fibrosis ("normal"), 830 (35%) had simple steatosis, and 1006 (42%) had NASH. When comparing prevalence of normal liver, simple steatosis, and NASH by genotype, it was observed that the prevalence of normal liver did not appear to differ by genotype (23%, 24%, and 23% for T/T, T/TA, and TA/TA carriers, respectively, P=0.5 by Chi-squared test for trend in proportions), but that the prevalence of NASH decreased (45%, 40%, and 31% for T/T, T/TA, and TA/TA carriers, respectively, P=1.6×10) and that of simple steatosis increased (33%, 35%, and 47% for T/T, T/TA, and TA/TA carriers, respectively, $P=1.1\times10^{-}$) with each TA allele (FIG. 9). Among individuals with steatosis, the TA allele was associated with statistically significantly lower odds of both NASH and fibrosis, as compared to simple steatosis ($OR_{allelic}$ 0.77 (0.66-0.90), $P=6.5\times10^{-4}$ for NASH; $OR_{allelic}$ 0.74 (0.62-0.88), $P=4.15\times10^{-4}$ for fibrosis; FIG. 2B), in an allele dosage-dependent manner. Altogether, these data suggest a role for HSD17B13 in mediating NAFLD progression from simple steatosis to more advanced stages of NASH and fibrosis.

Association of HSD17B13 rs72613567: TA with Clinical Quantitative Traits and Diagnoses To more comprehensively examine the clinical consequences of the HSD17B13 splice variant, we performed a phenome-wide study of associations of HSD17B13 rs72613567:TA with 405 quantitative EHR-derived anthropometric, vital sign, laboratory, electrocardiographic, echocardiographic, and bone densitometry measurements, and also with 3,168 EHR-derived clinical diagnoses. Using Bonferroni significance thresholds of $1.23\times10^{4}$ and $1.58\times10^{5}$ for associations with quantitative clinical measurements and clinical diagnoses, respectively, we identified statistically significant associations of the HSD17B13 rs72613567: TA allele with higher platelet counts, in addition to the associations with hepatic transaminases (Table 11). There were no statistically significant associations with clinical diagnoses other than chronic liver disease (OR(95% Cl)=0.88 (0.84-0.93); $P=9.14\times10^{-6}$; AAF=0.263; N Cases total=4031, T/T=2331, T/TA=1449, TA/TA=251; N Controls Total=35701, T/T=19238, T/TA=13984, TA/TA=2479).

TABLE 11

Phenome-Wide Study of Associations of HSD17B13 rs72613567:TA with Quantitative Clinical Measurements.

| | | | | | N | | | |
|---|---|---|---|---|---|---|---|---|
| Phenotype | Effect | SE | p | AAF | Total | T/t | T/TA | TA/TA |
| Alanine Aminotransferase median: Adjusted(Residual Log) | −0.009 | 0.001 | 1.74E−12 | 0.264 | 44038 | 23868 | 17115 | 3055 |
| Aspartate Aminotransferase median: Adjusted(Residual Log) | −0.006 | 0.001 | 2.75E−11 | 0.264 | 43370 | 23493 | 16851 | 3026 |
| Alanine Aminotransferase max: Adjusted(Residual Log) | −0.013 | 0.002 | 1.39E−09 | 0.264 | 43905 | 23797 | 17065 | 3043 |
| Aspartate Aminotransferase max: Adjusted(Residual Log) | −0.010 | 0.002 | 8.73E−09 | 0.264 | 42733 | 23145 | 16609 | 2979 |
| Platelets median: Adjusted(Residual Log) | 0.004 | 0.001 | 1.44E−08 | 0.264 | 46182 | 25020 | 17944 | 3218 |
| Alanine Aminotransferase min: Adjusted(Residual Log) | −0.008 | 0.002 | 2.47E−07 | 0.264 | 44029 | 23864 | 17111 | 3054 |
| Platelets min: Adjusted(Residual) | 1.919 | 0.443 | 1.47E−05 | 0.264 | 46181 | 25020 | 17943 | 3218 |

TABLE 11-continued

Phenome-Wide Study of Associations of HSD17B13 rs72613567:TA with Quantitative Clinical Measurements.

| Phenotype | Effect | SE | p | AAF | N Total | N T/t | N T/TA | N TA/TA |
|---|---|---|---|---|---|---|---|---|
| Platelets max: Adjusted(Residual Log) | 0.004 | 0.001 | 3.03E−05 | 0.264 | 46165 | 25014 | 17936 | 3215 |
| Aspartate Aminotransferase min: Adjusted(Residual Log) | −0.004 | 0.001 | 5.00E−05 | 0.264 | 43327 | 23471 | 16831 | 3025 |

Bolding and italicization indicates P-values meeting the Bonferroni significance threshold of $P < 1.23 \times 10^4$.
Abbreviations:
AAF, alternate allele frequency;
SE, standard error.

Effect of HSD17B13 rs72613567: TA on HSD17B13 mRNA and HSD17B13 Protein Expression We next examined the effect of the HSD17B13 rs72613567:TA allele on expression of known and novel transcripts of the gene. We used RNA sequencing to assess HSD17B13 mRNA expression in histologically normal liver samples from 22 T/T homozygous, 30 T/TA heterozygous, and 17 TA/TA homozygous carriers of the HSD17B13 rs72613567 splice variant. In addition to the two known HSD17B13 transcripts, A and B, two novel transcripts were identified: transcript C, which lacked exon 6, and transcript D which contained an insertion of a guanine nucleotide at the 3' end of exon 6, which would be predicted to result in premature truncation of the protein. Four additional transcripts (E-H) were expressed at very low levels (FIGS. 3A-3D and 6A-6D). The transcripts were validated by RT-PCR and Sanger sequencing. The D transcript was also validated using long read cDNA sequencing. Protein sequence alignment of all identified HSD17B13 isoforms (A-H) is shown in FIG. 7. The expression levels of these transcripts varied according to HSD17B13 rs72613567 genotype; levels of transcripts A and B decreased, while those of transcripts C and D increased in an allele dosage-dependent manner with each TA allele (FIGS. 3A-3D). Transcript A, which encodes the full-length 300 amino acid protein, was the predominant transcript in T/T homozygotes, while transcript D, which encodes the prematurely truncated protein, was the predominant transcript in TA/TA homozygotes. In human liver biopsy tissue, the truncated isoform D protein was minimally present in heterozygotes and TA/TA homozygotes, and isoform A protein abundance was reduced in an allele dosage-dependent manner (FIGS. 10B and 10C). Heterologous expression of isoforms A and D in HEK 293 cells indicated reduced abundance of isoform D relative to mRNA expression, suggesting instability of the D isoform when compared to isoform A (Figures I1A-11C). These data are consistent with HSD17B13 rs72613567 altering mRNA splicing, resulting in the synthesis of a truncated form of the protein with substantially reduced expression in human liver.

Expression of HSD17B13 in Human Liver Cells

Figure 12:
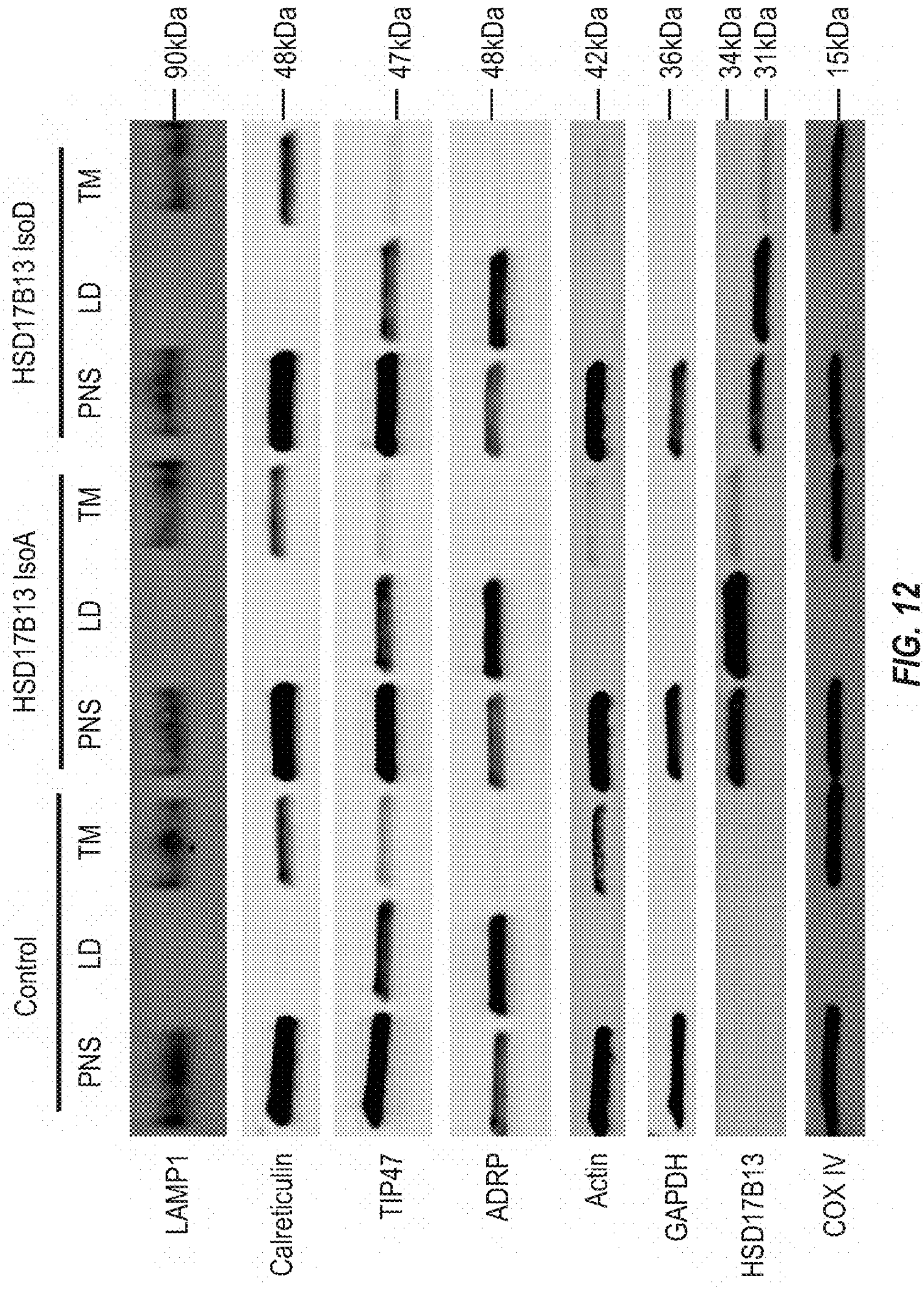
FIG. 12 shows similar localization patterns of HSD17B13 isoform A and isoform D to isolated lipid droplets (LD) derived from HepG2 stable cell lines. ADRP and TIP47 were used as lipid droplet markers. LAMP1, calreticulin, and COX IV were used as markers for the lysosomal, endoplasmic reticulum, and mitochondrial compartments, respectively. GAPDH was included as a cytosolic marker, and actin was used as a cytoskeletal marker. This experiment was repeated twice in HepG2 cells, with the above being representative of both runs. PNS=Post-nuclear fraction; TM=total membrane.
Figure 13A:
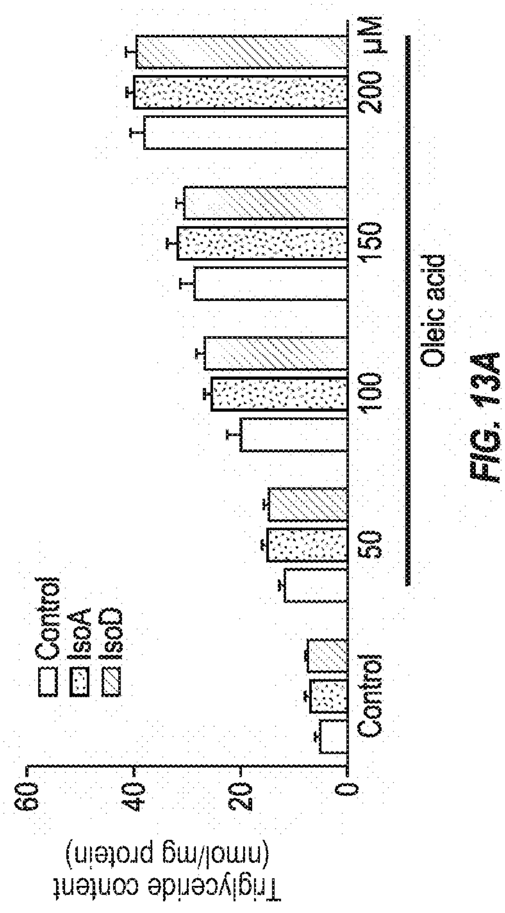
FIGS. 13A-13D show oleic acid increased triglyceride content in HepG2 cells overexpressing HSD17B13 Transcript A or D.
Figure 13B:
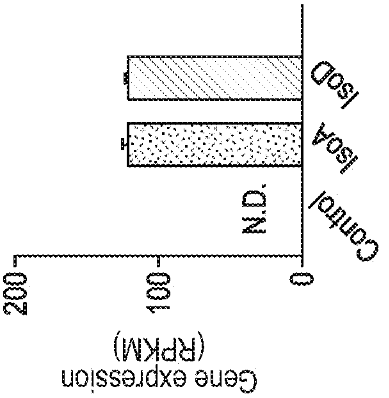
Figure 13C:
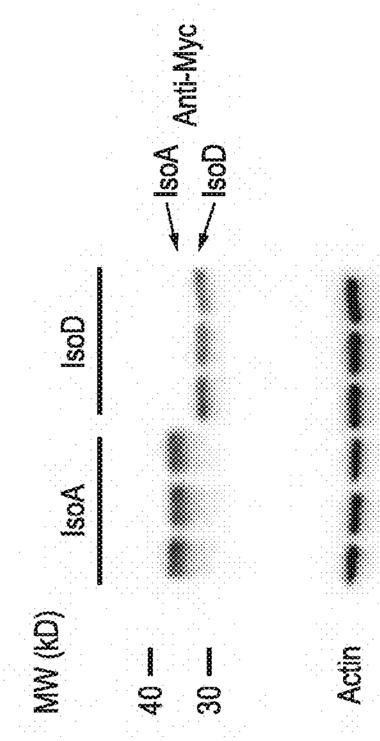
Figure 13D:
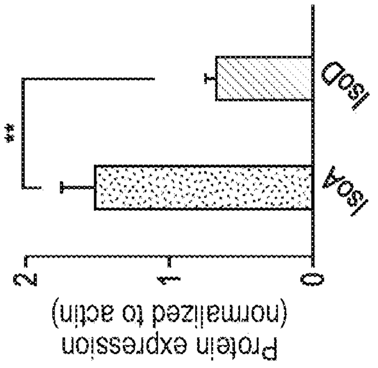

HSD17B13 is expressed primarily in the liver (Liu et al., *Acta Biochim. Pol.* 2007, 54, 213-218, herein incorporated by reference in its entirety for all purposes), where it localizes to lipid droplets (Su et al., Proc. Natl. Acad. Sci. USA, 2014, 111, 11437-11442, doi:10.1073/pnas.1410741111, herein incorporated by reference in its entirety for all purposes), consistent with a role in the pathogenesis of fatty liver disease. We evaluated the expression of HSD17B13 and its localization in an immortalized human liver cell line stably transduced with lentivirus expressing HSD17B13 transcript A or D. HSD17B13 isoform A was mainly detected on membranes surrounding BODIPY-labeled lipid droplets (data not shown). Similar subcellular localization was observed for HSD171313 isoform D at the lipid droplet surface (data not shown and FIG. 12). No differences in intracellular triglyceride content were observed with oleic acid treatment of cell lines overexpressing GFP control or HSD17B13 isoforms A or D (FIGS. 13A-13D).

Effect of rs72613567: TA on HSD17B13 Activity in vitro and in Cellular Models

Figure 14:
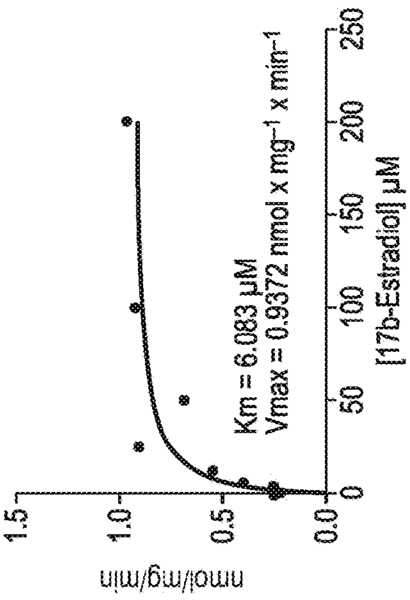
FIG. 14 shows $K_m$ and $V_{max}$ values for estradiol using purified recombinant HSD17B13 protein. For $K_m$ and $V_{max}$ determinations, assays were performed with a dose range of 17β-estradiol between 0.2 μM to 200 μM and time points from 5 minutes to 180 minutes, with 500 μM $NAD^+$ and 228 nM HSD17B13. $V_{max}$ and $K_m$ were then determined using the Michaelis-Menten model and Prism software (GraphPad Software, USA).

To understand the functional consequences of premature truncation of the HSD17B13 protein due to rs72613567:TA, we evaluated the enzymatic activity of isoforms A and D in vitro using recombinant protein and nicotinamide adenosine dinucleotide as cofactor. We tested 265 unique putative substrates, and identified steroid substrates and bioactive lipids (e.g. leukotriene B4) as enzymatic substrates of HS17B13. We focused subsequent characterization of HSD17B13 enzymatic activity on enzymatic conversion of estradiol ($V_{max}$ and $K_m$ values in FIG. 14), which resulted in oxidation of a hydroxyl to a ketone group. HSD17B13 isoform D showed greatly reduced activity towards estradiol in vitro (FIG. 10D) and in cell-based enzymatic conversion assays (FIG. 10E) when compared to HSD17B13 isoform A.

By linking large-scale exome sequencing to EHR-derived clinical phenotypes, we identified a novel association between a splice variant in HSD17B13 and decreased serum transaminase levels, as well as reduced risk of nonalcoholic and alcoholic forms of liver disease. These associations were observed consistently in four independent cohorts, and across several different liver disease categories, including advanced cirrhotic forms of liver disease and HCC. The HSD171313 rs72613567:TA allele was not associated with simple steatosis, but was associated with reduced risk of NASH and fibrosis, suggesting that this variant allele protects from progression to more clinically advanced stages of chronic liver disease. In a phenome-wide association study, HSD17B13 rs72613567:TA was not significantly associated with clinical diagnoses or measurements other than chronic liver disease and associated clinical measurements (hepatic transaminases and platelet counts), suggesting that the clinical effects of the variant allele may be specific to chronic liver disease.

Other hydroxysteroid 17-beta dehydrogenase family members are involved in sex steroid and fatty acid metabolism (Moeller, *Mol. Cell. Endocrinol.,* 2009, 301, 7-19, doi:10.1016/j.mce.2008.10.040, herein incorporated by reference in its entirety for all purposes), but little is known about the function of HSD17B13. HSD17B13 overexpression was shown previously to increase lipogenesis in mouse liver, and to increase the number and size of lipid droplets in cultured hepatocytes (Su et al., Proc. Nall. Acad. Sci.

USA, 2014, 111, 11437-11442, doi:10.1073/pnas.1410741111, herein incorporated by reference in its entirety for all purposes). Two previous studies also showed that hepatic expression of HSD17B13 protein is increased in patients with fatty liver (Su et al., *Proc. Natl. Acad. Sci. USA,* 2014, 111, 11437-11442, doi:10.1073/pnas.1410741111 and Kampf et al., *FASEB. J.,* 2014, 28, 2901-2914, doi:10.1096/fj.14-250555, each of which is herein incorporated by reference in its entirety for all purposes). Our data suggest that both HSD17B13 isoforms are expressed on the lipid droplet membrane, but do not appear to modulate intracellular neutral fat content, a finding that mirrors the lack of an association between the HSD17B13 rs72613567:TA and simple steatosis in humans. Although the physiological substrates of HSD17B13 are not known, enzymatic studies demonstrate that the HSD17B13 isoform encoded by the HSD17B13 rs72613567:TA allele is catalytically defective against estradiol. While at this time it is not clear if any of the substrates tested are critical for liver disease, it is intriguing that HSD17B13 has enzymatic activity against several bioactive lipid species (e.g. leukotriene B4) that have previously been implicated in lipid-mediated inflammation (Li et al., Nature Medicine, 2015, 21, 239-247, doi:10.1038/nm.3800, herein incorporated by reference in its entirety for all purposes).

This HSD17B13 variant may provide an avenue to new therapeutic strategies targeting chronic liver disease, similar to genetic variants that have guided the way to new therapeutics in other domains. Our data indicate that HSD17B13 modulates progression of liver disease from steatosis to later stages of NASH, fibrosis, and cirrhosis, which are associated with significant morbidity and mortality, and for which there are currently no effective treatments.

Example 4. Modification of Mouse Hsd17b13 Locus Using CRISPR/Cas9 Ex; Viva and In Vivo As a proof of concept for targeting Hsd17b13 using the CRISPR/Cas9 system, mouse Hsd17b13 guide RNAs targeting either the exon 1 region or the exon 6/7 region of the mouse Hsd17b13 locus were tested. The guide RNA target sequences are provided in Table 12. The guide RNA DNA-targeting segments corresponding to SEQ ID NOS: 259-268 are set forth in SEQ ID NOS: 1643-1652, respectively, which are identical to SEQ ID NOS: 259-268 except with uracils instead of thymines. The NCBI Gene ID for mouse Hsd17b13 (hydroxysteroid (17-beta) dehydrogenase 13 is 243168 (SEQ ID NO: 269). The mouse genomic locus is on chromosome 5, NC_000071.6 (103955442.103977388, complement).

TABLE 12

Guide RNA Target Sequences for Mouse

| | | | SEQ ID NO | | | | | |
|---|---|---|---|---|---|---|---|---|
| Region of Hsd17b13 | # | Guide RNA Target Sequence | gRNA Target Seq | crRNA | sgRNA v1 | sgRNA v2 | sgRNA v3 | sgRNA v4 |
| Exon 1 | 1 | GGCAGACCGTTCTCATCACG | 259 | 490 | 720 | 950 | 1180 | 1410 |
| | 2 | CTTTACCAGTGACTCCAGGT | 260 | 491 | 721 | 951 | 1181 | 1411 |
| | 3 | GTCACAGATTTCCTTCTCCG | 261 | 492 | 722 | 952 | 1182 | 1412 |
| | 4 | AGATGATGACGCCCACCAGA | 262 | 493 | 723 | 953 | 1183 | 1413 |
| | 5 | GGAGAAGGAAATCTGTGACC | 263 | 494 | 724 | 954 | 1184 | 1414 |
| Exons 6/7 | 1 | TGCGAGGAACTTACTTTTCC | 264 | 495 | 725 | 955 | 1185 | 1415 |
| | 2 | AGAGAAATATTGATATAGGA | 265 | 496 | 726 | 956 | 1186 | 1416 |
| | 3 | TATCAATATTTCTCTGATCC | 266 | 497 | 727 | 957 | 1187 | 1417 |
| | 4 | ATCGCTTTTAAGGCACGCTC | 267 | 498 | 728 | 958 | 1188 | 1418 |
| | 5 | TATACGACTGATCGCTTTTA | 268 | 499 | 729 | 959 | 1189 | 1419 |

The guide RNAs were first tested ex vivo in primary mouse hepatocytes isolated from hybrid wild type mice (75% C57BL/6NTac 25% 129S6/SvEvTac). Livers from mice were perfused with 50 mL liver perfusion medium containing 1× PenStrep, followed by 50 mL liver digestion medium (HBSS, 100 mM $CaCl_2$), 500 mM HEPES, collagenase). Once livers appeared digested, they were placed into wash medium containing 1× PenStrep and L-glutamine. The livers were torn to release the hepatocytes from the liver through gentle shaking. Once cells were released, they were put through a 70 μm mesh filter and spun at 50 g for 4 minutes at 4 °C. The pellets were washed 2× with wash buffer. The pellets were then re-suspended in 20 mL of 38-40% Percoll and spun at 200g×10 min at 4 °C. The pellet was washed 2× and re-suspended in plating medium (Williams E Media, 1× Penstrep, 1× L-glutamine, 5% FBS). Cells were plated at 300,000 cells per well in 24-well collagen-coated tissue culture plates. After the cells were allowed to attach for 6-18 hrs, the plating medium was replaced with medium without FBS. Reagents used are shown in Table 13.

TABLE 13

Reagents for Isolation of Primary Hepatocytes.

| Material | Catalog Number |
|---|---|
| Liver Perfusion Media | Gibco [17701-038] |
| HBSS (1x) | Gibco [14175-079] |
| Hepatocyte Wash Media | Gibco [17704-024] |
| Williams E media | Gibco [A12176-01] |
| Penstrep (100x) | Gibco [15140163] |
| L-glutamine (200 mM) | Gibco [25030081] |
| FBS supplement | Gibco [A13450] |
| HEPES | Gibco [15630080] |
| Collagen | Gibco [A1048301] |
| Acetic acid | Sigma [A6283] |
| Liberase TM | Roche [TM05401119001] |
| Primary Hepatocyte Thawing and Plating Supplements | Gibco [CM3000] |
| Primary Hepatocyte Maintenance Supplements | Gibco [CM4000] |
| Percoll | GE [17-0891-01] |

Ribonucleoprotein complexes (RNPs) containing Cas9 and a mouse Hsd17b13 gRNA were added to the freshly isolated primary mouse hepatocytes. For ex vivo experiments in primary mouse hepatocytes, modular guide RNAs having a separate crRNA and tracrRNA were used. The crRNA SEQ ID NOs are set forth in Table 12, and the tracrRNA sequence is set forth in SEQ ID NO: 1422. Each Cas9/gRNA RNP complex was transfected at a final concentration of 2 nM using CRISPRMAX™. After 48 hrs, DNA lysates were prepared from the cells, and next-generation sequencing was performed for each guide RNA tested to determine insertion/deletion (indel) frequency over the predicted cut sites.

Figure 15:
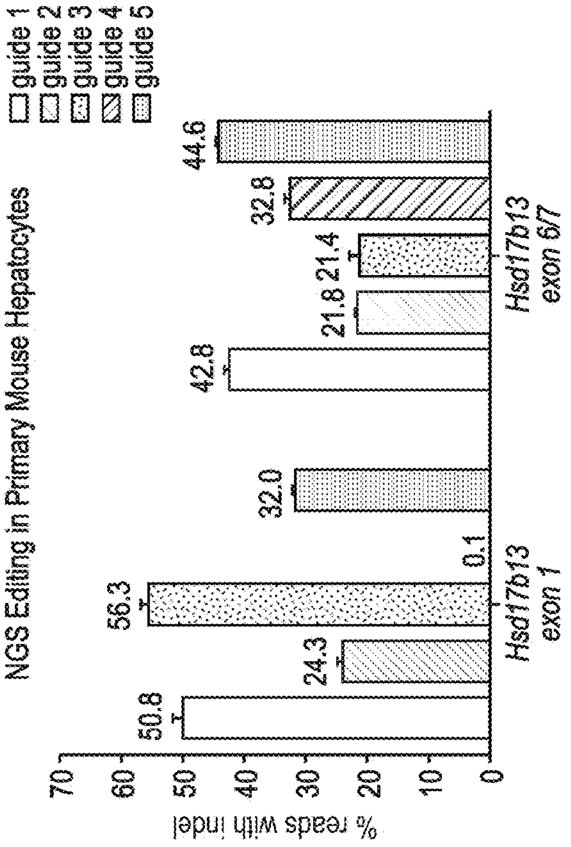
FIG. 15 shows percent genome editing (total number of insertions or deletions observed within a window 20 base pairs on either side of the Cas9-induced DNA break over the total number of sequences read in the PCR reaction from a pool of lysed cells) at the mouse Hsd17b13 locus as determined by next-generation sequencing (NGS) in primary hepatocytes isolated from hybrid wild type mice (75% C57BL/6NTac 25% 129S6/SvEvTac). The samples tested included hepatocytes treated with ribonucleoprotein complexes containing Cas9 and guide RNAs designed to target the mouse Hsd17b13 locus.

FIG. 15 shows editing levels (% reads with indels) in the mouse Hsd17b13 gene with each of the guide RNAs in primary mouse hepatocytes, including each of the five guide RNAs targeting the exon 1 region and each of the five guide RNAs targeting the exon 6/7 region. Editing efficiency refers to the total number of insertions or deletions observed over the total number of sequences read in the PCR reaction from a pool of lysed cells as determined by next generation sequencing. Nearly all of the guide RNAs showed an editing efficiency of at least 20%.

Next, the five mouse Hsd17b13 guide RNAs were tested in vivo in mice with a genomically integrated Cas9 gene (Cas9-ready mice). For in vivo experiments in mice, chimeric single guide RNAs were used. The DNA-targeting sequence for each guide RNA is equivalent to the guide RNA target sequence set forth in Table 12, with uracils replacing the thymines. Each single guide RNA included the DNA-target sequence upstream (5') of the gRNA scaffold set forth in SEQ ID NO: 1420. The sgRNA SEQ ID NOs are set forth in Table 12 (column for sgRNA v1). Other sgRNA variations using different guide RNA scaffold are included in Table 12 but were not tested. For each guide RNA, three Cas9-ready male mice were dosed per group. Guide RNAs were introduced via adeno-associated virus (AAV8) carrying an sgRNA expression cassette by tail vein injection (1E11 per mouse in 100 μL PBS). Wild type mice that do not express any Cas9 were dosed with all five guide RNAs as a negative control. Three weeks post-injection, the animals were euthanized, and blood serum was harvested along with liver and other tissues. The tissues were processed into DNA lysates that were then analyzed by NGS sequencing.

Figure 16:
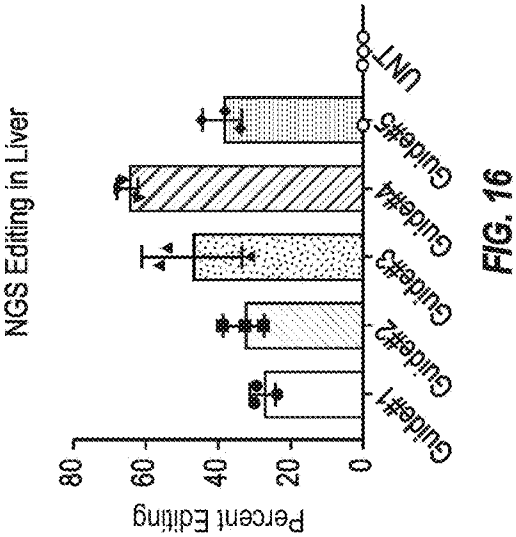
FIG. 16 shows percent genome editing (total number of insertions or deletions observed over the total number of sequences read in the PCR reaction from a pool of lysed cells) at the mouse Hsd17b13 locus as determined by next-generation sequencing (NGS) in samples isolated from mouse livers three weeks post-injection of AAV8 containing sgRNA expression cassettes designed to target mouse Hsd17b13 into Cas9-ready mice. Wild type mice not expressing any Cas9 were injected with AAV8 containing all of the sgRNA expression cassettes were used as a negative control.

As shown in FIG. 16, NGS sequencing showed significant editing in liver for all five guide RNAs (percent editing of at least 20% for each). Editing efficiency refers to the total number of insertions or deletions observed over the total number of sequences read in the PCR reaction from a pool of lysed cells. Minimal or no statistically significant levels of gene editing were observed in other tissues (data not shown).

Serum chemistry analysis for the liver enzymes ALT, AST, triglycerides, total cholesterol, HDL, LDL, non-esterified fatty acids (NEFA), and albumin showed little difference between various treatment groups (data not shown).

Figure 17A:
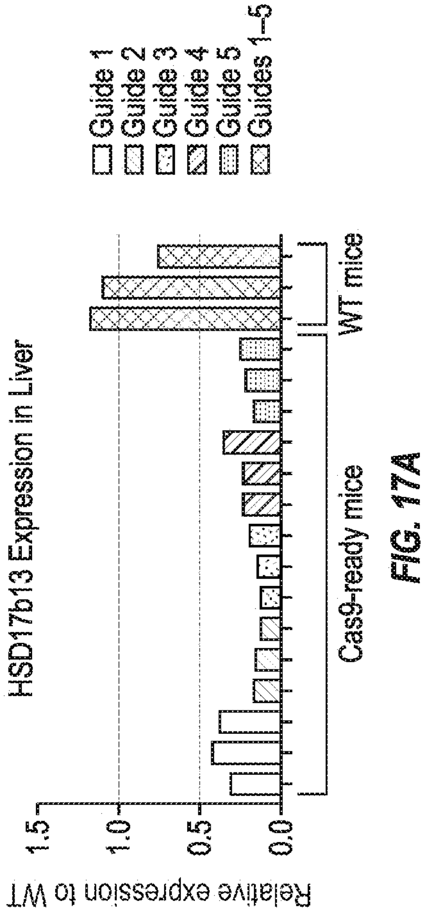
FIGS. 17A and 17B show relative mRNA expression for mouse Hsd17b13 and a non-target HSD family member, respectively, as determined by RT-qPCR in liver samples from Cas9-ready mice treated with AAV8 carrying guide RNA expression cassettes designed to target mouse Hsd17b13. Wild type mice not expressing any Cas9 were injected with AAV8 carrying guide RNA expression cassettes for all of the guide RNAs were used as a negative control.
Figure 17B:
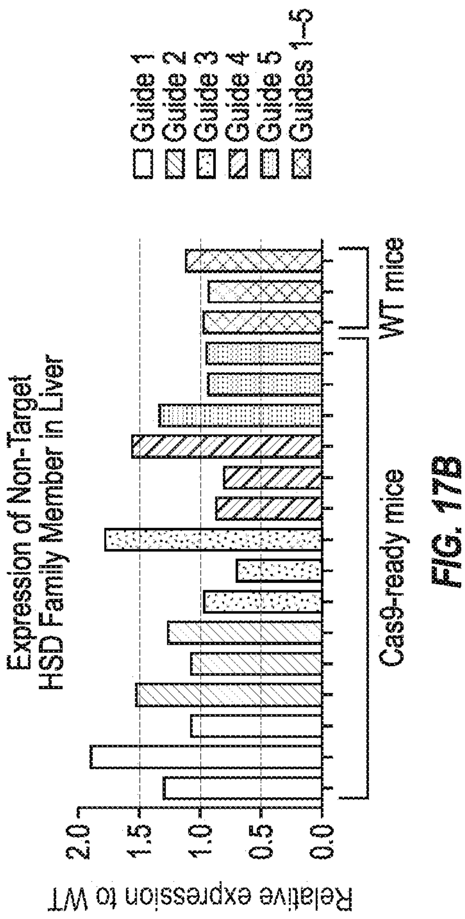

Hsd17b13 expression was evaluated by assessing equal mass amounts of RNA from liver by RT-qPCR. The genomic DNA was degraded so that it would not count towards the qPCR reaction. The RNA was reverse transcribed and then an assay specific to Cas9 was used to detect Cas9 transcripts. Each individual Hsd17b13 guide RNA showed at least 50% ablation of Hsd17b13 mRNA expression. See FIG. 17A. In contrast, no significant decreases were observed in expression of a non-target HSD family member. See FIG. 17B.

SEQUENCE LISTING (1652 sequences)

SEQ ID NO: 1 - DNA, 19118 bp, Homo sapiens
  source 1..19118: mol_type = genomic DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 2 - DNA, 19119 bp, Homo sapiens
  source 1..19119: mol_type = genomic DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtaatgtatacatcttccaactttttaaagtcacagagtaagatatgtattttaagaattatttgacttaccatctacttatctttgtatttttgtttttcaaagtttgataaattccctggtcccttagtctgtatatgtgtcaggttagttagatgaagggaatgtaattaagaactaagcagcgatttttatgacatggtgtgcaggttgatagaaagactcaggagccagtctccttccaagctgctaaatgaggcaagtcacatattatctctcagcctgttttcttggctctgaagtggggataataacttaggggatgggcaagaacgggatctgaaaattacagctacaaacaaaagtcaaacgaagaacttgcaacagaaacctttagtgcctcccctcatgcacaagcaacacagttctaaaatatttactgtctgaccctttacagaaaatgtttgccagtccgtagtcaaaaggattaaataagtaatattttcagcacttagcatatgataaacgatacgtggcacatgataaacaataactgtgttaaataaaatatgtgcgcagtgagtcaggcttttccttggacattagtatttttcctgtgttcttacttgtaaacactacattaacaaccccaaataaaactgaaggaactgaaatcttgtatcattttctctaaacttgtaaattctggtaaggccatgaaaatatatgcagagaagtgtttacaggattttaggattggaaaaattgtgaagtactccttgagaatcacattttctgcaaattacagtggttttaattaccattatattattactttctcatgttctttgctgtcatgtttagttgaaacctaaaatgtctcttacacttagagaactaattcttttctgttttttttctgaatagtgaagaatactatacaaaaaagctactacatttttatttaacagatatgagcatttatataatagaggagttgatgtatataaaaatgatttgccatctttttggtctttgaagaaattcgaatgaactttctggaagatagcaagaatttacaaatagagaaaattgttgcctgctgttctcaggcatttgtccaaaaatataaataagtataaatctatgaaaagggcttgatgaaatctaaccttcaaatctctttccagatgtgtatttttggggaaagggctatatttattaagttttttttaaattttaaaatttccagagacaagagaaaagtaaattagaaggaagtcgtattaaaaatgacttaagggcgggtgcagtggctcacacctgtaatcccagcactttgggagacggaggtgggcagattgctggagcccaggagttcaagaccagcctgggcagcacagcaaaacccccaactctacaaaaaatacaaaaattagctgggtgcgggggtgcacacccgtagtcccagctactcgggaggctgaggtgggaggatcgtttcagttcaggaagccaaggctgcaatgagctatgatggcatcattgcactccaagctgggcaatagagccaggctctgtctcaaaaaaaataaaaaaagacttaagaaaaataggtaacccaacctcaaaaattctctttgaatcattaaatttcatggttaaacatttaagctactgaatgattcactctaaggctgtaatgtaactcagatctcctttaggcgaggaagatgctggctgagttttcatcataactggctccttttgccctgtgagatgagagacacagtagcagtttggctcttatgcaatctaaactgttgcgttgggaatacggttcaaaaaacacattggagtttaagctaaagcaagtgttttgctaacaaaaagacaaggcatcacattttgcaattgtctagctcagttataaaacagaagaataggccggacgcggtggctcacgcctgtaatcccagcactttgggaggccgagacgggcggatcacgaggtcaggagatcgagaccatcctggataacacagtgaaaccccgtctctactaaaaatacaaaaaaattagccaggcgtagtggcgggcgcctgtagtcccagctactcgggaggctgaggcaggagaatggtgtgaacccgggaggcggagcttgcagtgagccgagatgacgccactgcactccagcctgggcgacagagcgagactccgtctcaaaaaaaaaaaaaaaaaaaaaactgaagaataattaattcttcaatcaaaacatctgatgaatgctctggtaacttatgctctctactgacctagaaacaaatgagagagtatggtgtggtttgtgcaatctggcagtgagcaagctaccaactaaatcagtgaaagactctcctattctttttttactcttctgcaatcccacaaaaggctatttgaggggatactgactttgagactgggtcctaacatccatgtttggggagttcaggctgctgctccagggtttagcctacagtagcgaaatacaaaggacccagagaccactcattcaaggtttgccctaaatagcagcaacaccactgtcatctcaatacacgaagaatagggcttttcaggtatccttgcctctttgtcacagagaagagtttacagattgtgagacggaaaagtataatttttaaaaccttataatattttctataaaagtcacctgaggtgaaaacttgaaaagaattataattttccagaatgtgagtcaagaaacattagagcaattttatcttaggaaagaggtctttgaatttaggctgaaagtaaattgctctgtctccatgtcctatggttatgggcaagtttggtacataaatgagaaatccatccagtggccttgcccatctcactcccaaacacctgaagaatgtaatgttatatctcctagagtagcagcatggtctccctatgaaagtccttcttctttaaggagacttctttcccttccctcctaggaggatgagtcagaatcatcaagaaaaatatgatgggcagaggcatacagtttaccattaccactagtttagaattactacttagcactttactgcctattacatagttggtgctcaacaaatgtatgataaattaatggttgagtttttctttcttctccatattcatcttccatgacaccacgaagagcaatgtttttcaagaatgttcttcaaggtttgaaagtagcctgctttagagaaactgcctactgtacagcctccaaccaagaggaaaagctgaaaaaagcatgaagggattttgttttgttttgtttgttttggttttaatatgagcattccctggcagaaaagccaggggtaatctcattgcaactaggcaatcactctcaagaaattttctaacaaataaggaggccaatttttattttattttgagacgaagtcccactctgtcacccaggttggagtgcaatggaatgatttcagctcactgcaacctccgcctcccgggttcaagtgattctcctgtctaaacttcccgagtagctgggattacaggctcccaccaccacgcccagctaattttttgtatttttagtagagatggggtttcaccattttggccagactggtctcaaactcctgacctcaagtgatccaccctcctcggcctcctaaagtgctgggattacaggcgtgagccaccacacctgacccaggaggccaatttttaaaaggttaactaatcttcatgtccaaaatgaatgttaattgttcattttggacatgaatgttaattttttttttttttttttttgagacagagtctcactctgttgcccaggctggagtccagtggcactatctccactcactgcaacttcctcctcccaggttcaagcaattatcctgcctcagcctcccaagtagctgggattacaggcccacaccatcaggcctggctaatttttgtatttttagtagagacggggtttcaccatgttggccaggctggtcttgaactcctgacctcgtgatccgccctcctcggccaaccaaagtgctgggattacaggcgtgagccaccgcgcctagccgaatgttaattgtctaaaaatttttcttctccaatgtcttctcctccacttttttcggaatttgtttcttcctaattacagcgcggtgtggaggaaactgcagctgagtgccgaaaactaggcgtcactgcgcatgcgtatgtggtagactgcagcaacagagaagagatctatcgctctctaaatcaggtgagactgcaggttcacaaatttcttcagattattttgtttcctaggacgctgacgtggaaaatgagaaaggtctttatgactgcctgatttaaattggattttagctgctaactgaagtagttatgtcaccaaggaaggatatatactttttttcttgtatgtaatccactcagctctgcccattattattgttcatattattaatcaatttcattctgatcagaagtgtgagcagtggcacagagtgactgacaaaagatttatcatcagggaatatggatcacttcctagttttgttttagtcctattaactttgcagtaattccagcttctctttaattatttcccttgtgagattttattttggtgttaatgtagtcttctgtagaaaatgtaatattaataattattatcacaattattttaaaagagtaaataccaaataatcacaatgaactaagcactctaacaaactttacattttttaattcaatccctacaataactctgtaaacttcattttacagataagcaaattatgactcagagaggttaagccagacccaggtcatgtagttattaggttatgaaaccaggatttctcaaccagcactttagaccaggtgcggtggttcacacatgtaatcccagcactttgtgaggccaaggtggaaggatcacatgagaccaagagttcaagaccagcccaggcaacatagtgagaccctatctctaaaaaaaaaaaaaaaaaaaaaaaaaaaagtttaaagaaaaacacatttttaaaaaatgaacactttaaaaatatttggtcagaatttatataggaatttatcaacataaatgttaatttcactttactgataaacttgcaaaacatgatgtgctgggtactgaaatttagatgttaaaagaacagtttatcccacctttatgacagtgttcccttggcctccacgatttgagctcaacagtctgtcttgcctgaactctgagagacctcatacaatagaagaaagactctcatctttggattatattggtcccaaaactttgagtttgaataatacacccagtgaaagtgttctttcaatttcaaaaggtgaagaaagaagtgggtgatgtaacaatcgtggtgaataatgctgggacagtatatccagccgatcttctcagcaccaaggatgaagagattaccaagacatttgaggtcaacatcctaggacatttttgggtgagtgtgagtcagaaacatttctgatttgtgcaccttctcttaagatacatgaaacttataacggagttcacatacttctggacaggaaactggccagatctttgccttaatcaagaatcattaaatttgtttgagtagaagagccacagagtctctgacacaaggacacagaattcaagtggacacaacacaccagaatgtaagctacttggtctgtcttgtccaccagtatctgacacaaagcttggcatgtaccaggagctcaacaaatgtttgtggaggtttgttaagggttgtcagtgtacatcttttcaatgctgtcacttgtgacttcatttttttccctccacaccatgattttgtaatgtgtcctcattttgtggaattttagaatggaaaggacatcagaagtaattacttggatgtatataggatcgaggacacttttggacgagactctgaggcaagtgttctagatccatggggtgctggaactgagaaatgcagctatacagacctcatataattggttagttttgtgggagatggaaatatcaacttcaactgcctttgtatagaaatttttatgattaatcttccagtgcctcaatattagtgtagaatctagggcagatctggattctagaagaaagaagaaaaaaaagagatgtgtcccccttacctttaccagctcttcacatatgtgaattggctcccatgcccaccaaactacacggagacctcatacattagctacctatagctgcataacaaattatacaaaacttagtggtttaaagcaacaatgtatgttcactatcctctcacagtttctatgggttgggaatttggaggtagcttgggttgggagttctagttctatgaatttgcataggatttattaaattcttataaaattttattgatgtttctcacaaaagaggtttttggaaaaaaagaaagacttgttttctgtaacatcaacatataatatacaatattacaaatagggagatagtgaattcaatcatgattcattagtgtggtgtagaactctcagcttacactactcaactgtcttaatacagttacacaagatttcactcttttaattagaatgataaagccccaaaccaaaaaattatatgacaccaaattatcataaggaataattttagttctgaaaactctgaatttttcccttaatattgtttagatgacatatccaaaaaaggatctatttgattccttctgaagggaaggagggggagtactgagattagtgttggcatggggcttaccataccaataaatttgtatctttatttctatcatttgtaaagaattaatcatggaatgcttggaagtattttatttcattgtataagttctctcaaatgcctttctgtcttaacaaaaataaaactacctgatttggaaacctaacgtctatgtcattgtctttcttctttctgcaatgatccttaagatcacaaaagcacttcttccatcgatgatggagagaaatcatggccacatcgtcacagtggcttcagtgtgcggccacgaagggattccttacctcatcccatattggtaagtatcacatgccagccatgttatatatttttatactttgaagggagcattacacttcaaattgttaccactggagagtcctggttcttggcatcttgaacaaagaattggacaaaactcaccaacaaagccaggaaagaatgaagcaacaaaagcagagatttattgaaaatgaaagtacgctttacagggtgggagtgggcccaagcacaggggctcaagagccaattacagaattttctggggtttaaataccccctagaggtttccactggttacttggtgtacgccctatgtaaatgaagaggatgaattaaagttacagagtcgtttactcagtgtacaccatatgtaaatggagaggatatttcctgtcatagctggagtgtttccatttgatttagttctaggaagtcagcatgaatcggccttatgttccctgcctccagaccctgttctcctgcctcaagattacaatgctgagagcagagtgatttggatttacagaatttaaatttatagtagtttagaatgattttttaaatgactttttctaaaacaatgaaaccaggttgtaattatatttaagatatttttagatttctgcaaactcctctgtagaacaatgagagaaaacagtaatgccaagcatgtttccattgtttcctggaataagaaacagaaaccccacagactgagaagcaaaacctacagaagctaaaatgaacacatgtctatgtcatggccttggtgcccaagataagacaatcagagtggtccctggatcaaaacattttacagtgtgcttgtgccatgaaagtgtgtgtgtgtgtgtgtgtgtgtgtgtgagagagagagagagagagaaaacgactctacctgactaaaagttgcagataccacactccatgcaccaccaaagacataaagggaaggaggtgagaggcgttaaggatgtactgctgtatttgccaaatatcctttcctgtaaactcttctccagatcctcataataaaattaagaggccaaagtggcaaccattgtcaagagaaaaactatcaaccattgtcaagagaataactcagttattgagagagagaggagaaatgagcagagtcctacagaagtctgtcaacacagataccagttttgtagaatttctaaatgtatttttcctgattcatatttttcaaaataaaagcagcaataaaaactgattagaaaacagtttgaagattcaatggaaaaaccttacatgtaggatggaaaactgaacattaagccaatcaatagagttatttttgttcttttgttatcattgttgtttaagaaatgagatacgttcacaattctgcttaatcatgtaagaaaatgaaaatgaattgccatttatactctcagaaaaatcacaagtggctgatttttggcttccacttgttcttaagccaaatgataccgccttctcacagaaagctgaggattggtttcactctcccttagctaacaatgcttaataattctcttacagttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtaaggtcaaaatcaagttagaatgggtatgtggtatgataaattgatatgaaaactaatgagaaatgtttaggcaggccaactaatagaagaaaatgaagaaggaaaaataatttttcttattattattattatcttgaaattaaaggaataaagggggaaaacacattagggactagcaggaatgatcagccaccgatgaactgggatatttatttgtgtccgggagaaagcacatacatttgatcaccgttaccaccctgtctttaaaatgcaaatgttccaaggaccagcaaataaattgagtatctagctccttagtcaaggtgaatttctgcaagaactcttgtctctggtgagacaggatttgagaccacaagagaagaaaaattagtcctgaaaggagaagaaaaaagcaggaaggtgtggataagaacccgaaaattaagccatctgcttaacaaatttttctaatcctagtatatattctgctgcaggttaacaaaatatactaagcttaatgattcgaaaccaattttttactggaagggaattaatcctaaatatattcattcaaaagaactaaacaattctctgttgagtgccgcctcatttgaggatactgactcttacagcctgagttagctatgtggtctctgcagctggaatcactccctgccactggagtccttcatggtgttagaccataggtactgttgactaaagaaaaaaaaaagtttttgtttttatttttgttttttttgagacagagtctcactctgtcacccaggctggagtacagtggcgcgatctcagctcaccgcaacctccgcctttctgggttcaagcaattctccttcctcagcctcctgagtatttggattacaggcgcccaccaccacgcctggctaatttttgtatttttagtagagacggggtttcaccatgttggccaggctggtctcaaactcctgacctcaggtgtcctacctgccttggcctcctaaaatgctgggattacaggagtgagccaccatgcccggccaaaaaaataagtttttaaagaattaaaggtcatcctggctaacacagtgaaaccccgtctctactaaaaaacacaaaaaaattagccgggcgtggtggcgggcgcctgtagtcccagctgcgcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaaaaaaaaagaattaaaggtgttaattttatttagaagccttactgaagactacagtcggaggcctatagcctgagagcagccctttagagaggttcagttgaactgttctgatagtgggggccatgtgctctatcctgtattgtcttcaaagcatctttccagagagctgcacattgtcacagagtcagggactttgtgaaattatgctgacaaccagaagtgagtaaacgtggcttcttacatttgctacgttgtctcacagtacttaataagtatgcaatatgtaagtaaatactatagtactattgcaactcctgattgttttcttagacaaggaattgggcccaataaaaaccctcttggtaggcattcaggcttcgtgtaccatgagctttcctaagggtatcctgccactcttggggaaggcatgatagatgaggggagtaaggataatggaactctgggtacagggttcctgggggctaacttagaggtagacacaggcaatgctaaatatttgggattgattttatagaggttgctagattgtgaatttccttagtaagggctaaggcattgatatgtaatgtcacacttggctccgaggctgggttgttggatccatgtagatgaaatcagggagagaaagggcagaacggagtaatttagaaatgtattgatttgtattactctctgttggcttgctattcaaggcagtggagaactcaatcacataataatctgcagcaaaccacagatcatcccagggaatgaagttttaacattcgctggctccctaactcctcacccagcctttacattcactggctgttcagtccatgcctggacatcttaatttgaatacaacattttaaatccatttttctgtcatcatcttgcactaacagacaattctacactaagcctatgtttatgaatatttctcaagagtacatgtacacagccttcagtataaggaaaactggaagtatgacatacctccagttgtcatactccttgggcccctcttaaattctcattaaactgcaggataggcaagtcagaggtgaatctcaaatacgaaattcttaccggaaaggggttccaatccagaccccaagagagggttcttagatttctcgcaagaaataattcggggcaaggccacagtgcaaagcaaaagcaagtttattaggaaagtaaaggagtagagaacagctactccatggagaagaatggcttgagctgctccaccaagggtatttagagttacttcttgattatatgctaaacaaggggtggattattcatgagttttccgggaaaagggtgagcaattcccagaactgagatttcctcccctttttaggccatatagggtaacttcctgccattgccatggtatttgtaaactgtcatagtgctggtggaagtgtctcttagcttgctaatgtattatagttagcttataatgagcagtgaggacaaccagaggtcactttcatcaccatcttggttttggtgggttttggccggcttctttactgcaccctattttatcaacaaggtctttatgacctgaatcttgtgccaacctcctatctcatcctgtgacaaagaatgccttaacttcctgggaatgcagcccagtaggtgtcagccttattttacccagaccctattcaagatggagttgctctgatttaaacgcctctgacaaaatgacgacctcaaaacaatccagctttatggaatacctccacaagaaagaaagtatacttagctatagaattttctccttgcatccaacaggctttgagatgtcagatgtttccttcctgtcccatgattaatcctagccattcctctttcttgtctggctccactactccttaccatctaatgcctcgccaccattttgatattttgactaagtgagctatgaaacacacctactggatatgaaagtataagtttctgataacaaaacatcaacatgggatgtggaggaagtgggtagggtggcattaatgcagcaaatcctggaatattttaaatcttcattctaaatttagtaaaaatataggataattttcctgccatcatttacttataaaattaaaattttagaaaataaaaataatattttcctctttttaatcacagattatggcctgtattggagacagatgaagtcgtaagaagtctgatagatggaatacttaccaataagaaaatgatttttgttccatcgtatatcaatatctttctgagactacagaagttaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttttttttttttttttttttttttgagacagagtttcacccttgttgcccaggctggagtgcagtggcgtgatcttggctcactgcagcttctgcctcctggcttcaagtgattctcctgcctcagcctcccaagtagctgggattacaggcacctgccccctcgcccaactaactttttgtgtttgtagtagagacagggtttcaccatgttggccaggctggtctcgaactcctgacctcatgtgatccacctgcctcagcctcccaaagtgctgggattacaggcatgagccatcatgcccagccctatttgacggtttttgacgctaatgcaagtggcattttaaaaaattttatatttcccattgtttgttgtcagtatatattggatttttgtaatttgatctcatattttgcagtcttgctaaattgctaaacctctttttgctaaactcgataagcttttttttttttggtagattcctgggcctctaattttctttatgggaaagtttttaattacaaatttaatttctttaatagctacatggctattcaatttacttattaattcttggtaatgtgtgtctttcaaggaatttgtccatttcatctaagttgtagaatttctttggcataaatttgtacataacattcccttattatccttttaatgtctttagaatgtcttatttatttatttatttatttttattatatttttttgagacagagtctcgctctgttgcccaggctggagtgcagtggcacaatcttggctcactgcaagctccgccttctgggttcatgccattctcctgcctcagcctccctagttgctgggactacaggcgcctgcaaccatgcccagcttattttttttttttttttttttttttttttttttttttttttttttttagtagagacggggtttcaccctgttagccaggatggtctcgatctcctgacctggtgatccgcccgcctcagcctcccaaagtgctgggattacaggcgtgagccaccaagcccagcctatttatttatttagtagagacagtctcactttgctgcccaggcaacaaaggttttgaatgcctggcctcaagcagtcctcctgccttggcctcccaaagtgctgggattacaggcatgagccactgcacctggccaaatgaatatgctgataatatcttctttataaggatgacataagaataaaataatgtaatacaaacaaagcccctgtcactgaaaatgtatagacttcaaatgttaaagtcttagagaacagaatttatatgaaatagcaacagcaacaatttcccagaggaaatactctctcagctttcttctgaggagcagtttctaaattgaaattgtatcagtgagaagataactatactaacttcataagccttgggcctttttgaaacaaatccatataaactatgaacaaacttgaaatagaacaatttgagaacagggtacaaactgcattggtgtatcaatttcagtatttggttttagcttaaatagactgacttgagataacataaggagaaccttgacccccaagcaacatcatctcgcgagttgactaggccgggtgtggtgtctcacgcctgtaattccagcactttgggaggccacagcaggcagatcacttgaggtcaggcattcgagaccagcctggccaacatggtgaaacctcagctctactaaagatacgaaaattagcaggcatagtggcctgcacctgtaataccaggcactcgcaggagaatcccttgaacccggaaggcggagattgcagtaaaccatgattgtgccactgcactccagcctgggcaacaggagactctgtctcggaaaaataaattttttaaaaaaatgaaaaaaaataaaagttgactaaattagtgtcttggtactaagcactgtaggaagtgagtttcatggaaccccaactctcttggggcccaaagcaagtcatattaatattgaaaattacatgcatatacatgcatatgaccaaggtgataaaaacaattattctgcctgagttggagaatagtatcccagtaaaataaacaagagtctcaaagtcttttgtatcctttgaagctgtcatggtggtttgtaactaggcaacaggtatatattgttaatcttctttgcatttaattccttttatagagagacacaattttacgagcagatgcaattactagcatgaaggtttctttgtgagggtagttaaaaggcccacatgagctctcttcttatccttgtccttctttcagccagatcttccctgcccctttgctcattccatctttcacccacctacccccaaaacaaggaagtaaatcttgcattagtcaacaataccaaagtgattttcaatatgactttctctgcagaatgttattatttctgcctctttacattcacatactgtcttcctttttttttttttttttttttttttttttagattgggtctcactctgttgcccaggctggagtgcagtggcttgatctcagctcactgtaacctccacctcctgagttcaagcaattctcctgcctcagcctcctgagtagctgggattacaggcatgtgccaccacacctggctagtttttttgtatttttagtagagacagggtttcaccatgttggtcaagctggtctcgaactcctgacctcatgatctgaccacctgtgcctctcaaagtgctgggattacaggcgtgagccaccgggccagccactctcttcctttcagttgcctactcatctcttatgcattcctggacatcagttgtccttttgaagctttcctccactatcccagcccatgtgaatcctccttccagttatagcccttaattctagatggctgatatttttcaataattgttttaagatgaccattttagcctatcagctaaacaatatcaaagacaatagctatttttcaagtactttagtttaccttattatagagtgcataatagatattcagtaaatagtaaaggagaggtgaaggcttgcatagaatggattctggtggtgtctcttggtgagcttttagcatcaagattaatcagcagtttcagcaatgagctcagaccttcagttttagatctttactcatatcagataagagagtgagaagagtggtatgtatcagtgctttatttatatttgcatccaatttgaactatgaatattacaaaggtgcacacataggttcagacagattgatttaaaatgaccaaagatgacctgtcgtaagcaacctgggtatcttaagatgcactccttggagagggaatgttcctaaaaacattttcagagggacgaactgtatgaaattcagtaaaacataaatcatgaggaaaactgattactctctttttgacatgaaatgagagttttaatgcatggttacgattattaacgtactccgctgcaagacgttaataaagttactgttttgcaggctagaatgtcttgatgctgtaatcagaacacactttttcccctttcttccagcttcaaatgcagattcataattgggctgacttctaataactgcaatgttttctgccttgggcttgcagcagaagcctgacaaaatagtgtttgtttaggcaataatttatttatttatttattgagatggagtttcattcttgtcgcccaggctggagtgcaatggcgtgatctcggctcactgcaacctctgtgttcaggcaataatttagactttaccttacttgtgattactatagcaattactatagccacaaggcataattttactgtctcatttcaattttatgaatttgaatgtttttacacttttcctaatgaagtccactatgaagttatgtcaaaaaaaaaaaagaaaaagaaagatgcacacgtaaaagagaggtggttgcaagagaagaaaagaacggaggaaagttaaacgcaaaccagataactctcagcgtattctaaatgaccaaaaacagaactctgttgtcaaagattttaaatggaaaatttttcaatttttttttcttttttgtacaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 3 - DNA, 600 bp, Homo sapiens
  misc_feature 1..499: note = Upstream of TSS
  source 1..600: mol_type = genomic DNA
cactgcaccacgaactcatggactgaagcaatcctcctgcctcagcctcctgggtagctgggactacagacacatgccaccatatccagctaatttttttctatagtttttttttttttttttgagacagggtcttactatgttgcccagactggtctcgaactcctgggctcaagcaatcctctgcctcagcctcccaaagtgctgggattacagatgtgagccactgcacctggcccctagaattgtttctagaggtgaaacttcaaggtgaaatatagtacataactgcttttcagataaacaagtccagagagcacactctcttgtgctcttggcatcacttggcatcacttcatatttgaggtgtttcaaacccattagaacacgtgaacaaggcctgcttccaaagctggcttccatctggtagtcccattaacaactgggcacaccccttccctagagctctgtgtagacagtacctcctccctaggactacacaaggactgaaccagaaggaagaggacagagcaaagccatgaacatcatcctagaaatccttctgcttctgatcaccatcatctactcctacttggagtc

SEQ ID NO: 4 - DNA, 2397 bp, Homo sapiens
  misc_feature 1..275: note = Exon 1
  misc_feature 276..383: note = Exon 2
  misc_feature 384..515: note = Exon 3
  misc_feature 516..622: note = Exon 4
  misc_feature 623..760: note = Exon 5
  misc_feature 761..877: note = Exon 6v1
  misc_feature 878..2397: note = Exon 7
  source 1..2397: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 5 - DNA, 2289 bp, Homo sapiens
  misc_feature 1..275: note = Exon 1
  misc_feature 276..407: note = Exon 3
  misc_feature 408..514: note = Exon 4
  misc_feature 515..652: note = Exon 5
  misc_feature 653..769: note = Exon 6v1
  misc_feature 770..2289: note = Exon 7
  source 1..2289: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 6 - DNA, 2280 bp, Homo sapiens
  misc_feature 1..275: note = Exon 1
  misc_feature 276..383: note = Exon 2
  misc_feature 384..515: note = Exon 3
  misc_feature 516..622: note = Exon 4
  misc_feature 623..760: note = Exon 5
  misc_feature 761..2280: note = Exon 7
  source 1..2280: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 7 - DNA, 2398 bp, Homo sapiens
  misc_feature 1..275: note = Exon 1
  misc_feature 276..383: note = Exon 2
  misc_feature 384..515: note = Exon 3
  misc_feature 516..622: note = Exon 4
  misc_feature 623..760: note = Exon 5
  misc_feature 761..878: note = Exon 6v2 - includes additional residue 878 at 3' end
  misc_feature 879..2398: note = Exon 7
  source 1..2398: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 8 - DNA, 2469 bp, Homo sapiens
  misc_feature 1..275: note = Exon 1
  misc_feature 276..383: note = Exon 2
  misc_feature 384..515: note = Exon 3
  misc_feature 516..587: note = Exon 3'
  misc_feature 588..694: note = Exon 4
  misc_feature 695..832: note = Exon 5
  misc_feature 833..949: note = Exon 6v1
  misc_feature 950..2469: note = Exon 7
  source 1..2469: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggaatggaaaggacatcagaagtaattacttggatgtatataggatcgaggacacttttggacgagactctgagatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 9 - DNA, 1715 bp, Homo sapiens
  misc_feature 1..275: note = Exon 1
  misc_feature 276..383: note = Exon 2
  misc_feature 384..515: note = Exon 3
  misc_feature 516..622: note = Exon 4
  misc_feature 623..760: note = Exon 5
  misc_feature 761..1715: note = Exon 6v3
  misc_feature 878..1715: note = Read-through from exon 6 into intron 6
  source 1..1715: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagttaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttt

SEQ ID NO: 10 - DNA, 2290 bp, Homo sapiens
  misc_feature 1..275: note = Exon 1
  misc_feature 276..407: note = Exon 3
  misc_feature 408..514: note = Exon 4
  misc_feature 515..652: note = Exon 5
  misc_feature 653..770: note = Exon 6v2 - includes additional residue 770 at 3' end
  misc_feature 771..2290: note = Exon 7
  source 1..2290: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 11 - DNA, 2470 bp, Homo sapiens
  misc_feature 1..275: note = Exon 1
  misc_feature 276..383: note = Exon 2
  misc_feature 384..515: note = Exon 3
  misc_feature 516..587: note = Exon 3'
  misc_feature 588..694: note = Exon 4
  misc_feature 695..832: note = Exon 5
  misc_feature 833..950: note = Exon 6v2 - includes additional residue 950 at 3' end
  misc_feature 951..2470: note = Exon 7
  source 1..2470: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggaatggaaaggacatcagaagtaattacttggatgtatataggatcgaggacacttttggacgagactctgagatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaaggtttcttcctgaacgcgcctcagcgattttaaatcgtatgcagaatattcaatttgaagcagtggttggccacaaaatcaaaatgaaatgaataaataagctccagccagagatgtatgcatgataatgatatgaatagtttcgaatcaatgctgcaaagctttatttcacattttttcagtcctgataatattaaaaacattggtttggcactagcagcagtcaaacgaacaagattaattacctgtcttcctgtttctcaagaatatttacgtagtttttcataggtctgtttttcctttcatgcctcttaaaaacttctgtgcttacataaacatacttaaaaggttttctttaagatattttatttttccatttaaaggtggacaaaagctacctccctaaaagtaaatacaaagagaacttatttacacagggaaggtttaagactgttcaagtagcattccaatctgtagccatgccacagaatatcaacaagaacacagaatgagtgcacagctaagagatcaagtttcagcaggcagctttatctcaacctggacatattttaagattcagcatttgaaagatttccctagcctcttcctttttcattagcccaaaacggtgcaactctattctggactttattacttgattctgtcttctgtataactctgaagtccaccaaaagtggaccctctatatttcctccctttttatagtcttataagatacattatgaaaggtgaccgactctattttaaatctcagaattttaagttctagccccatgataacctttttctttgtaatttatgctttcatatatccttggtcccagagatgtttagacaattttaggctcaaaaattaaagctaacacaggaaaaggaactgtactggctattacataagaaacaatggacccaagagaagaaaaggaagaaagaaaggttttttggtttttgttttgttttgttttgttttttgtttttttgagatggagtctcactctttcgcccaggctggagtgcagtggtatgatctcagctcactgcaagctccacctcccgggttcacgccattctcctgcctcagcctcctgagtagctgggactacaggcgcccgccaccacacccggctaattttttgtattttttgtagagacggggtttcaccatgttagccaagatggtctcgatctcctgacctcgtgatccacctgcctcggcctcccaaagtgctgggattacgggtgtgagccaccgtgcccagcctttttttttttaatagaaaaaataatccgactcccactacatcaagactaatcttgttttgtgtgtttttcacatgtattatagaatgcttttgcatggactatcctcttgtttttattaaaaacaaatgatttttttaaaagtcacaaaaacaattcactaaaaataaatatgtcattgtgctttaaaaaaataacctcttgtagttataaaataaaacgtttgacttctaaactctg

SEQ ID NO: 12 - protein, 300 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..185: note = MISC_FEATURE - Region Encoded by Exon 4
  REGION 186..232: note = MISC_FEATURE - Region Encoded by Exon 5
  REGION 233..271: note = MISC_FEATURE - Region Encoded by Exon 6v1
  REGION 272..300: note = MISC_FEATURE - Region Encoded by Exon 7
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 13 - protein, 264 aa, Homo sapiens
  REGION 1..70: note = MISC_FEATURE - Region Encoded by Exon 1
  REGION 71..114: note = MISC_FEATURE - Region Encoded by Exon 3
  REGION 115..149: note = MISC_FEATURE - Region Encoded by Exon 4
  REGION 150..196: note = MISC_FEATURE - Region Encoded by Exon 5
  REGION 197..235: note = MISC_FEATURE - Region Encoded by Exon 6v1
  REGION 236..264: note = MISC_FEATURE - Region Encoded by Exon 7
MNIILEILLLLITIIYSYLESLVKFFIPQRRKSVAGEIVLITGAGHGIGRQTTYEFAKRQSILVLWDINKVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 14 - protein, 261 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..185: note = MISC_FEATURE - Region Encoded by Exon 4
  REGION 186..232: note = MISC_FEATURE - Region Encoded by Exon 5
  REGION 233..261: note = MISC_FEATURE - Region Encoded by Exon 7
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRFLPERASAILNRMQNIQFEAVVGHKIKMK

SEQ ID NO: 15 - protein, 274 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..185: note = MISC_FEATURE - Region Encoded by Exon 4
  REGION 186..232: note = MISC_FEATURE - Region Encoded by Exon 5
  REGION 233..271: note = MISC_FEATURE - Region Encoded by Exon 6v2
  REGION 272..274: note = MISC_FEATURE - Region Encoded by Exon 7
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKVSS

SEQ ID NO: 16 - protein, 324 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..174: note = MISC_FEATURE - Region Encoded by Exon 3'
  REGION 175..209: note = MISC_FEATURE - Region Encoded by Exon 4
  REGION 210..256: note = MISC_FEATURE - Region Encoded by Exon 5
  REGION 257..295: note = MISC_FEATURE - Region Encoded by Exon 6v1
  REGION 296..324: note = MISC_FEATURE - Region Encoded by Exon 7
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWNGKDIRSNYLDVYRIEDTFGRDSEITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKFLPERASAILNRMQNIQFEAVVGHKIKMK

SEQ ID NO: 17 - protein, 284 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..185: note = MISC_FEATURE - Region Encoded by Exon 4
  REGION 186..232: note = MISC_FEATURE - Region Encoded by Exon 5
  REGION 233..284: note = MISC_FEATURE - Region Encoded by Exon 6v3
  REGION 272..284: note = MISC_FEATURE - Region Encoded by Read-Through Into Intron 6
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKLSTAQNTQILKHQ

SEQ ID NO: 18 - protein, 238 aa, Homo sapiens
  REGION 1..70: note = MISC_FEATURE - Region Encoded by Exon 1
  REGION 71..114: note = MISC_FEATURE - Region Encoded by Exon 3
  REGION 115..149: note = MISC_FEATURE - Region Encoded by Exon 4
  REGION 150..196: note = MISC_FEATURE - Region Encoded by Exon 5
  REGION 197..235: note = MISC_FEATURE - Region Encoded by Exon 6v2
  REGION 236..238: note = MISC_FEATURE - Region Encoded by Exon 7
MNIILEILLLLITIIYSYLESLVKFFIPQRRKSVAGEIVLITGAGHGIGRQTTYEFAKRQSILVLWDINKVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKVSS

SEQ ID NO: 19 - protein, 298 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..174: note = MISC_FEATURE - Region Encoded by Exon 3'
  REGION 175..209: note = MISC_FEATURE - Region Encoded by Exon 4
  REGION 210..256: note = MISC_FEATURE - Region Encoded by Exon 5
  REGION 257..295: note = MISC_FEATURE - Region Encoded by Exon 6v2
  REGION 296..298: note = MISC_FEATURE - Region Encoded by Exon 7
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWNGKDIRSNYLDVYRIEDTFGRDSEITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQKVSS

SEQ ID NO: 20 - DNA, 20 bp, Homo sapiens
  source 1..20: mol_type = other DNA
tgaagtttttcattcctcag

SEQ ID NO: 21 - DNA, 20 bp, Homo sapiens
  source 1..20: mol_type = other DNA
cttcaccaacgactccaagt

SEQ ID NO: 22 - DNA, 20 bp, Homo sapiens
  source 1..20: mol_type = other DNA
ctactcctacttggagtcgt

SEQ ID NO: 23 - DNA, 20 bp, Homo sapiens
  source 1..20: mol_type = other DNA
ctccaagtaggagtagatga

SEQ ID NO: 24 - DNA, 20 bp, Homo sapiens
  source 1..20: mol_type = other DNA
caccatcatctactcctact

SEQ ID NO: 25 - DNA, 20 bp, Homo sapiens
  source 1..20: mol_type = other DNA
tgatggtgatcagaagcaga

SEQ ID NO: 26 - DNA, 20 bp, Homo sapiens
  source 1..20: mol_type = other DNA
tcagaagcagaaggatttct

SEQ ID NO: 27 - DNA, 20 bp, Homo sapiens
  source 1..20: mol_type = other DNA
gatttctaggatgatgttca

SEQ ID NO: 28 - DNA, 20 bp, Homo sapiens
  source 1..20: mol_type = other DNA
ttgctctgtcctcttccttc

SEQ ID NO: 29 - DNA, 20 bp, Homo sapiens
  source 1..20: mol_type = other DNA
aggactgaaccagaaggaag

SEQ ID NO: 30 - DNA, 20 bp, Homo sapiens
  source 1..20: mol_type = other DNA
tacacaaggactgaaccaga

SEQ ID NO: 31 - DNA, 20 bp, Homo sapiens
  source 1..20: mol_type = other DNA
ttcagtccttgtgtagtcct

SEQ ID NO: 32 - DNA, 20 bp, Homo sapiens
  source 1..20: mol_type = other DNA
tcagtccttgtgtagtccta

SEQ ID NO: 33 - DNA, 20 bp, Homo sapiens
  source 1..20: mol_type = other DNA
gtccttgtgtagtcctaggg

SEQ ID NO: 34 - DNA, 20 bp, Homo sapiens
  source 1..20: mol_type = other DNA
cttgtgtagtcctagggagg

SEQ ID NO: 35 - DNA, 20 bp, Homo sapiens
  source 1..20: mol_type = other DNA
ctcctccctaggactacaca

SEQ ID NO: 36 - DNA, 20 bp, Homo sapiens
  source 1..20: mol_type = other DNA
gtagacagtacctcctccct

SEQ ID NO: 37 - DNA, 20 bp, Homo sapiens
  source 1..20: mol_type = other DNA
tactgtctacacagagctct

SEQ ID NO: 38 - DNA, 20 bp, Homo sapiens
  source 1..20: mol_type = other DNA
actgtctacacagagctcta

SEQ ID NO: 39 - DNA, 20 bp, Homo sapiens
  source 1..20: mol_type = other DNA
tctacacagagctctaggga

SEQ ID NO: 40 - DNA, 20 bp, Homo sapiens
  source 1..20: mol_type = other DNA
ctacacagagctctagggaa

SEQ ID NO: 41 - DNA, 20 bp, Homo sapiens
  source 1..20: mol_type = other DNA
tacacagagctctagggaag

SEQ ID NO: 42 - DNA, 20 bp, Homo sapiens
  source 1..20: mol_type = other DNA
tgtcaggttagttagatgaa

SEQ ID NO: 43 - DNA, 20 bp, Homo sapiens
  source 1..20: mol_type = other DNA
gtgtcaggttagttagatga

SEQ ID NO: 44 - DNA, 20 bp, Homo sapiens
  source 1..20: mol_type = other DNA
cctgacacatatacagacta

SEQ ID NO: 45 - DNA, 20 bp, Homo sapiens
  source 1..20: mol_type = other DNA
ctgacacatatacagactaa

SEQ ID NO: 46 - DNA, 20 bp, Homo sapiens
  source 1..20: mol_type = other DNA
ccttagtctgtatatgtgtc

SEQ ID NO: 47 - DNA, 20 bp, Homo sapiens
  source 1..20: mol_type = other DNA
catatacagactaagggacc

SEQ ID NO: 48 - DNA, 20 bp, Homo sapiens
  source 1..20: mol_type = other DNA
atatacagactaagggacca

SEQ ID NO: 49 - DNA, 20 bp, Homo sapiens
  source 1..20: mol_type = other DNA
tcaaagtttgataaattccc

SEQ ID NO: 50 - DNA, 20 bp, Homo sapiens
  source 1..20: mol_type = other DNA
aaaatacaaagataagtaga

SEQ ID NO: 51 - DNA, 20 bp, Homo sapiens
  source 1..20: mol_type = other DNA
actctgtgactttaaaaagt

SEQ ID NO: 52 - DNA, 20 bp, Homo sapiens
  source 1..20: mol_type = other DNA
ggttctgtgggatattaata

SEQ ID NO: 53 - DNA, 20 bp, Homo sapiens
  source 1..20: mol_type = other DNA
acagagcatattggttctgt

SEQ ID NO: 54 - DNA, 20 bp, Homo sapiens
  source 1..20: mol_type = other DNA
gacagagcatattggttctg

SEQ ID NO: 55 - DNA, 20 bp, Homo sapiens
  source 1..20: mol_type = other DNA
tgcaaaacgacagagcatat

SEQ ID NO: 56 - DNA, 20 bp, Homo sapiens
  source 1..20: mol_type = other DNA
gagctgggcatggaataggc

SEQ ID NO: 57 - DNA, 20 bp, Homo sapiens
  source 1..20: mol_type = other DNA
actggagctgggcatggaat

SEQ ID NO: 58 - DNA, 20 bp, Homo sapiens
  source 1..20: mol_type = other DNA
ctcattactggagctgggca

SEQ ID NO: 59 - DNA, 20 bp, Homo sapiens
  source 1..20: mol_type = other DNA
ttgttctcattactggagct

SEQ ID NO: 60 - DNA, 20 bp, Homo sapiens
  source 1..20: mol_type = other DNA
attgttctcattactggagc

SEQ ID NO: 61 - DNA, 20 bp, Homo sapiens
  source 1..20: mol_type = other DNA
ggggagattgttctcattac

SEQ ID NO: 62 - DNA, 20 bp, Homo sapiens
  source 1..20: mol_type = other DNA
gaggagaaaatctgtggctg

SEQ ID NO: 63 - DNA, 20 bp, Homo sapiens
  source 1..20: mol_type = other DNA
agaggagaaaatctgtggct

SEQ ID NO: 64 - DNA, 20 bp, Homo sapiens
  source 1..20: mol_type = other DNA
cagaggagaaaatctgtggc

SEQ ID NO: 65 - DNA, 20 bp, Homo sapiens
  source 1..20: mol_type = other DNA
tcctcagaggagaaaatctg

SEQ ID NO: 66 - DNA, 20 bp, Homo sapiens
  source 1..20: mol_type = other DNA
ggggtgtgcccagttgttaa

SEQ ID NO: 67 - DNA, 20 bp, Homo sapiens
  source 1..20: mol_type = other DNA
gggtgtgcccagttgttaat

SEQ ID NO: 68 - DNA, 20 bp, Homo sapiens
  source 1..20: mol_type = other DNA
tggtagtcccattaacaact

SEQ ID NO: 69 - DNA, 20 bp, Homo sapiens
  source 1..20: mol_type = other DNA
ctggtagtcccattaacaac

SEQ ID NO: 70 - DNA, 20 bp, Homo sapiens
  source 1..20: mol_type = other DNA
ttgttaatgggactaccaga

SEQ ID NO: 71 - DNA, 20 bp, Homo sapiens
  source 1..20: mol_type = other DNA
taccagatggaagccagctt

SEQ ID NO: 72 - DNA, 20 bp, Homo sapiens
  source 1..20: mol_type = other DNA
ttccaaagctggcttccatc

SEQ ID NO: 73 - DNA, 20 bp, Homo sapiens
  source 1..20: mol_type = other DNA
tggaagccagctttggaagc

SEQ ID NO: 74 - DNA, 20 bp, Homo sapiens
  source 1..20: mol_type = other DNA
acaaggcctgcttccaaagc

SEQ ID NO: 75 - DNA, 20 bp, Homo sapiens
  source 1..20: mol_type = other DNA
gccttgttcacgtgttctaa

SEQ ID NO: 76 - DNA, 20 bp, Homo sapiens
  source 1..20: mol_type = other DNA
ccttgttcacgtgttctaat

SEQ ID NO: 77 - DNA, 20 bp, Homo sapiens
  source 1..20: mol_type = other DNA
cccattagaacacgtgaaca

SEQ ID NO: 78 - DNA, 20 bp, Homo sapiens
  source 1..20: mol_type = other DNA
ttggcatcacttcatatttg

SEQ ID NO: 79 - DNA, 20 bp, Homo sapiens
  source 1..20: mol_type = other DNA
cttgtgctcttggcatcact

SEQ ID NO: 80 - DNA, 20 bp, Homo sapiens
  source 1..20: mol_type = other DNA
agcacactctcttgtgctct

SEQ ID NO: 81 - DNA, 20 bp, Homo sapiens
  source 1..20: mol_type = other DNA
gcacaagagagtgtgctctc

SEQ ID NO: 82 - DNA, 20 bp, Homo sapiens
  source 1..20: mol_type = other DNA
gcttaatctcacacatagaa

SEQ ID NO: 83 - DNA, 20 bp, Homo sapiens
  source 1..20: mol_type = other DNA
cttaatctcacacatagaaa

SEQ ID NO: 84 - DNA, 20 bp, Homo sapiens
  source 1..20: mol_type = other DNA
ttaatctcacacatagaaag

SEQ ID NO: 85 - DNA, 20 bp, Homo sapiens
  source 1..20: mol_type = other DNA
aggagtgctggtttatcaac

SEQ ID NO: 86 - DNA, 20 bp, Homo sapiens
  source 1..20: mol_type = other DNA
ttctttgacagcaggagtgc

SEQ ID NO: 87 - DNA, 20 bp, Homo sapiens
  source 1..20: mol_type = other DNA
actctggtttctttgacagc

SEQ ID NO: 88 - DNA, 20 bp, Homo sapiens
  source 1..20: mol_type = other DNA
accagagttgagaaaacccc

SEQ ID NO: 89 - DNA, 20 bp, Homo sapiens
  source 1..20: mol_type = other DNA
tccaggggttttctcaactc

SEQ ID NO: 90 - DNA, 20 bp, Homo sapiens
  source 1..20: mol_type = other DNA
cagttattaaatgaatccag

SEQ ID NO: 91 - DNA, 20 bp, Homo sapiens
  source 1..20: mol_type = other DNA
gcagttattaaatgaatcca

SEQ ID NO: 92 - DNA, 20 bp, Homo sapiens
  source 1..20: mol_type = other DNA
ggcagttattaaatgaatcc

SEQ ID NO: 93 - DNA, 20 bp, Homo sapiens
  source 1..20: mol_type = other DNA
tggatggtaacagctacatc

SEQ ID NO: 94 - DNA, 20 bp, Homo sapiens
  source 1..20: mol_type = other DNA
gctgttaccatccacatcct

SEQ ID NO: 95 - DNA, 20 bp, Homo sapiens
  source 1..20: mol_type = other DNA
tcaagaaccaaggatgtgga

SEQ ID NO: 96 - DNA, 20 bp, Homo sapiens
  source 1..20: mol_type = other DNA
tccttcaagaaccaaggatg

SEQ ID NO: 97 - DNA, 20 bp, Homo sapiens
  source 1..20: mol_type = other DNA
tgagtgtccttcaagaacca

SEQ ID NO: 98 - DNA, 20 bp, Homo sapiens
  source 1..20: mol_type = other DNA
ttttattttataactacaag

SEQ ID NO: 99 - DNA, 20 bp, Homo sapiens
  source 1..20: mol_type = other DNA
ttgtttttaataaaaacaag

SEQ ID NO: 100 - DNA, 20 bp, Homo sapiens
  source 1..20: mol_type = other DNA
tattatagaatgcttttgca

SEQ ID NO: 101 - DNA, 20 bp, Homo sapiens
  source 1..20: mol_type = other DNA
caagattagtcttgatgtag

SEQ ID NO: 102 - DNA, 20 bp, Homo sapiens
  source 1..20: mol_type = other DNA
aagattagtcttgatgtagt

SEQ ID NO: 103 - DNA, 20 bp, Homo sapiens
  source 1..20: mol_type = other DNA
agtcttgatgtagtgggagt

SEQ ID NO: 104 - DNA, 20 bp, Homo sapiens
  source 1..20: mol_type = other DNA
tttttctattaaaaaaaaaa

SEQ ID NO: 105 - DNA, 20 bp, Homo sapiens
  source 1..20: mol_type = other DNA
tctattaaaaaaaaaaaggc

SEQ ID NO: 106 - DNA, 20 bp, Homo sapiens
  source 1..20: mol_type = other DNA
ctattaaaaaaaaaaaggct

SEQ ID NO: 107 - DNA, 20 bp, Homo sapiens
  source 1..20: mol_type = other DNA
aaaaaaaaaaaggctgggca

SEQ ID NO: 108 - DNA, 20 bp, Homo sapiens
  source 1..20: mol_type = other DNA
aaaaaaaaggctgggcacgg

SEQ ID NO: 109 - DNA, 20 bp, Homo sapiens
  source 1..20: mol_type = other DNA
cacccgtaatcccagcactt

SEQ ID NO: 110 - DNA, 20 bp, Homo sapiens
  source 1..20: mol_type = other DNA
acccgtaatcccagcacttt

SEQ ID NO: 111 - DNA, 20 bp, Homo sapiens
  source 1..20: mol_type = other DNA
cgtaatcccagcactttggg

SEQ ID NO: 112 - DNA, 20 bp, Homo sapiens
  source 1..20: mol_type = other DNA
tcccaaagtgctgggattac

SEQ ID NO: 113 - DNA, 20 bp, Homo sapiens
  source 1..20: mol_type = other DNA
ctcccaaagtgctgggatta

SEQ ID NO: 114 - DNA, 20 bp, Homo sapiens
  source 1..20: mol_type = other DNA
cccagcactttgggaggccg

SEQ ID NO: 115 - DNA, 20 bp, Homo sapiens
  source 1..20: mol_type = other DNA
cctcggcctcccaaagtgct

SEQ ID NO: 116 - DNA, 20 bp, Homo sapiens
  source 1..20: mol_type = other DNA
gcactttgggaggccgaggc

SEQ ID NO: 117 - DNA, 20 bp, Homo sapiens
  source 1..20: mol_type = other DNA
ctttgggaggccgaggcagg

SEQ ID NO: 118 - DNA, 20 bp, Homo sapiens
  source 1..20: mol_type = other DNA
gccgaggcaggtggatcacg

SEQ ID NO: 119 - DNA, 20 bp, Homo sapiens
  source 1..20: mol_type = other DNA
acctcgtgatccacctgcct

SEQ ID NO: 120 - DNA, 20 bp, Homo sapiens
  source 1..20: mol_type = other DNA
ggcaggtggatcacgaggtc

SEQ ID NO: 121 - DNA, 20 bp, Homo sapiens
  source 1..20: mol_type = other DNA
tcaggagatcgagaccatct

SEQ ID NO: 122 - DNA, 20 bp, Homo sapiens
  source 1..20: mol_type = other DNA
cgagaccatcttggctaaca

SEQ ID NO: 123 - DNA, 20 bp, Homo sapiens
  source 1..20: mol_type = other DNA
tttcaccatgttagccaaga

SEQ ID NO: 124 - DNA, 20 bp, Homo sapiens
  source 1..20: mol_type = other DNA
ttgtattttttgtagagacg

SEQ ID NO: 125 - DNA, 20 bp, Homo sapiens
  source 1..20: mol_type = other DNA
tttgtattttttgtagagac

SEQ ID NO: 126 - DNA, 20 bp, Homo sapiens
  source 1..20: mol_type = other DNA
ttttgtattttttgtagaga

SEQ ID NO: 127 - DNA, 20 bp, Homo sapiens
  source 1..20: mol_type = other DNA
aaaaaatacaaaaaattagc

SEQ ID NO: 128 - DNA, 20 bp, Homo sapiens
  source 1..20: mol_type = other DNA
aaaaatacaaaaaattagcc

SEQ ID NO: 129 - DNA, 20 bp, Homo sapiens
  source 1..20: mol_type = other DNA
tacaaaaaattagccgggtg

SEQ ID NO: 130 - DNA, 20 bp, Homo sapiens
  source 1..20: mol_type = other DNA
aaaaaattagccgggtgtgg

SEQ ID NO: 131 - DNA, 20 bp, Homo sapiens
  source 1..20: mol_type = other DNA
aaattagccgggtgtggtgg

SEQ ID NO: 132 - DNA, 20 bp, Homo sapiens
  source 1..20: mol_type = other DNA
aattagccgggtgtggtggc

SEQ ID NO: 133 - DNA, 20 bp, Homo sapiens
  source 1..20: mol_type = other DNA
caggcgcccgccaccacacc

SEQ ID NO: 134 - DNA, 20 bp, Homo sapiens
  source 1..20: mol_type = other DNA
gcctgtagtcccagctactc

SEQ ID NO: 135 - DNA, 20 bp, Homo sapiens
  source 1..20: mol_type = other DNA
tgtagtcccagctactcagg

SEQ ID NO: 136 - DNA, 20 bp, Homo sapiens
  source 1..20: mol_type = other DNA
tcctgagtagctgggactac

SEQ ID NO: 137 - DNA, 20 bp, Homo sapiens
  source 1..20: mol_type = other DNA
cccagctactcaggaggctg

SEQ ID NO: 138 - DNA, 20 bp, Homo sapiens
  source 1..20: mol_type = other DNA
cctcagcctcctgagtagct

SEQ ID NO: 139 - DNA, 20 bp, Homo sapiens
  source 1..20: mol_type = other DNA
gcctcagcctcctgagtagc

SEQ ID NO: 140 - DNA, 20 bp, Homo sapiens
  source 1..20: mol_type = other DNA
aggaggctgaggcaggagaa

SEQ ID NO: 141 - DNA, 20 bp, Homo sapiens
  source 1..20: mol_type = other DNA
gcaggagaatggcgtgaacc

SEQ ID NO: 142 - DNA, 20 bp, Homo sapiens
  source 1..20: mol_type = other DNA
caggagaatggcgtgaaccc

SEQ ID NO: 143 - DNA, 20 bp, Homo sapiens
  source 1..20: mol_type = other DNA
gagaatggcgtgaacccggg

SEQ ID NO: 144 - DNA, 20 bp, Homo sapiens
  source 1..20: mol_type = other DNA
aatggcgtgaacccgggagg

SEQ ID NO: 145 - DNA, 20 bp, Homo sapiens
  source 1..20: mol_type = other DNA
cactgcaagctccacctccc

SEQ ID NO: 146 - DNA, 20 bp, Homo sapiens
  source 1..20: mol_type = other DNA
tcactgcaagctccacctcc

SEQ ID NO: 147 - DNA, 20 bp, Homo sapiens
  source 1..20: mol_type = other DNA
cataccactgcactccagcc

SEQ ID NO: 148 - DNA, 20 bp, Homo sapiens
  source 1..20: mol_type = other DNA
ataccactgcactccagcct

SEQ ID NO: 149 - DNA, 20 bp, Homo sapiens
  source 1..20: mol_type = other DNA
tcgcccaggctggagtgcag

SEQ ID NO: 150 - DNA, 20 bp, Homo sapiens
  source 1..20: mol_type = other DNA
tctcactctttcgcccaggc

SEQ ID NO: 151 - DNA, 20 bp, Homo sapiens
  source 1..20: mol_type = other DNA
ggagtctcactctttcgccc

SEQ ID NO: 152 - DNA, 20 bp, Homo sapiens
  source 1..20: mol_type = other DNA
tgttttttgtttttttgaga

SEQ ID NO: 153 - DNA, 20 bp, Homo sapiens
  source 1..20: mol_type = other DNA
aggaagaaagaaaggttttt

SEQ ID NO: 154 - DNA, 20 bp, Homo sapiens
  source 1..20: mol_type = other DNA
agaagaaaaggaagaaagaa

SEQ ID NO: 155 - DNA, 20 bp, Homo sapiens
  source 1..20: mol_type = other DNA
ctttcttccttttcttctct

SEQ ID NO: 156 - DNA, 20 bp, Homo sapiens
  source 1..20: mol_type = other DNA
tttcttccttttcttctctt

SEQ ID NO: 157 - DNA, 20 bp, Homo sapiens
  source 1..20: mol_type = other DNA
aatggacccaagagaagaaa

SEQ ID NO: 158 - DNA, 20 bp, Homo sapiens
  source 1..20: mol_type = other DNA
ggctattacataagaaacaa

SEQ ID NO: 159 - DNA, 20 bp, Homo sapiens
  source 1..20: mol_type = other DNA
cacaggaaaaggaactgtac

SEQ ID NO: 160 - DNA, 20 bp, Homo sapiens
  source 1..20: mol_type = other DNA
attaaagctaacacaggaaa

SEQ ID NO: 161 - DNA, 20 bp, Homo sapiens
  source 1..20: mol_type = other DNA
tcaaaaattaaagctaacac

SEQ ID NO: 162 - DNA, 20 bp, Homo sapiens
  source 1..20: mol_type = other DNA
taaaattgtctaaacatctc

SEQ ID NO: 163 - DNA, 20 bp, Homo sapiens
  source 1..20: mol_type = other DNA
agagatgtttagacaatttt

SEQ ID NO: 164 - DNA, 20 bp, Homo sapiens
  source 1..20: mol_type = other DNA
tctaaacatctctgggacca

SEQ ID NO: 165 - DNA, 20 bp, Homo sapiens
  source 1..20: mol_type = other DNA
tttatgctttcatatatcct

SEQ ID NO: 166 - DNA, 20 bp, Homo sapiens
  source 1..20: mol_type = other DNA
agcataaattacaaagaaaa

SEQ ID NO: 167 - DNA, 20 bp, Homo sapiens
  source 1..20: mol_type = other DNA
tacaaagaaaaaggttatca

SEQ ID NO: 168 - DNA, 20 bp, Homo sapiens
  source 1..20: mol_type = other DNA
acaaagaaaaaggttatcat

SEQ ID NO: 169 - DNA, 20 bp, Homo sapiens
  source 1..20: mol_type = other DNA
caaagaaaaaggttatcatg

SEQ ID NO: 170 - DNA, 20 bp, Homo sapiens
  source 1..20: mol_type = other DNA
tctgagatttaaaatagagt

SEQ ID NO: 171 - DNA, 20 bp, Homo sapiens
  source 1..20: mol_type = other DNA
cttataagatacattatgaa

SEQ ID NO: 172 - DNA, 20 bp, Homo sapiens
  source 1..20: mol_type = other DNA
tatcttataagactataaaa

SEQ ID NO: 173 - DNA, 20 bp, Homo sapiens
  source 1..20: mol_type = other DNA
atcttataagactataaaaa

SEQ ID NO: 174 - DNA, 20 bp, Homo sapiens
  source 1..20: mol_type = other DNA
ttataagactataaaaaggg

SEQ ID NO: 175 - DNA, 20 bp, Homo sapiens
  source 1..20: mol_type = other DNA
taaaaagggaggaaatatag

SEQ ID NO: 176 - DNA, 20 bp, Homo sapiens
  source 1..20: mol_type = other DNA
aaaaagggaggaaatataga

SEQ ID NO: 177 - DNA, 20 bp, Homo sapiens
  source 1..20: mol_type = other DNA
aaatatagagggtccacttt

SEQ ID NO: 178 - DNA, 20 bp, Homo sapiens
  source 1..20: mol_type = other DNA
tatagagggtccacttttgg

SEQ ID NO: 179 - DNA, 20 bp, Homo sapiens
  source 1..20: mol_type = other DNA
actctgaagtccaccaaaag

SEQ ID NO: 180 - DNA, 20 bp, Homo sapiens
  source 1..20: mol_type = other DNA
agaatagagttgcaccgttt

SEQ ID NO: 181 - DNA, 20 bp, Homo sapiens
  source 1..20: mol_type = other DNA
aaaacggtgcaactctattc

SEQ ID NO: 182 - DNA, 20 bp, Homo sapiens
  source 1..20: mol_type = other DNA
ccgttttgggctaatgaaaa

SEQ ID NO: 183 - DNA, 20 bp, Homo sapiens
  source 1..20: mol_type = other DNA
cctttttcattagcccaaaa

SEQ ID NO: 184 - DNA, 20 bp, Homo sapiens
  source 1..20: mol_type = other DNA
tgggctaatgaaaaaggaag

SEQ ID NO: 185 - DNA, 20 bp, Homo sapiens
  source 1..20: mol_type = other DNA
taatgaaaaaggaagaggct

SEQ ID NO: 186 - DNA, 20 bp, Homo sapiens
  source 1..20: mol_type = other DNA
aatgaaaaaggaagaggcta

SEQ ID NO: 187 - DNA, 20 bp, Homo sapiens
  source 1..20: mol_type = other DNA
ctgaatcttaaaatatgtcc

SEQ ID NO: 188 - DNA, 20 bp, Homo sapiens
  source 1..20: mol_type = other DNA
caggcagctttatctcaacc

SEQ ID NO: 189 - DNA, 20 bp, Homo sapiens
  source 1..20: mol_type = other DNA
ctaagagatcaagtttcagc

SEQ ID NO: 190 - DNA, 20 bp, Homo sapiens
  source 1..20: mol_type = other DNA
gtgttcttgttgatattctg

SEQ ID NO: 191 - DNA, 20 bp, Homo sapiens
  source 1..20: mol_type = other DNA
cttgttgatattctgtggca

SEQ ID NO: 192 - DNA, 20 bp, Homo sapiens
  source 1..20: mol_type = other DNA
tctgtggcatggctacagat

SEQ ID NO: 193 - DNA, 20 bp, Homo sapiens
  source 1..20: mol_type = other DNA
agaacttatttacacaggga

SEQ ID NO: 194 - DNA, 20 bp, Homo sapiens
  source 1..20: mol_type = other DNA
aaagagaacttatttacaca

SEQ ID NO: 195 - DNA, 20 bp, Homo sapiens
  source 1..20: mol_type = other DNA
caaagagaacttatttacac

SEQ ID NO: 196 - DNA, 20 bp, Homo sapiens
  source 1..20: mol_type = other DNA
ttctctttgtatttactttt

SEQ ID NO: 197 - DNA, 20 bp, Homo sapiens
  source 1..20: mol_type = other DNA
tctctttgtatttactttta

SEQ ID NO: 198 - DNA, 20 bp, Homo sapiens
  source 1..20: mol_type = other DNA
ctttgtatttacttttaggg

SEQ ID NO: 199 - DNA, 20 bp, Homo sapiens
  source 1..20: mol_type = other DNA
agcttttgtccacctttaaa

SEQ ID NO: 200 - DNA, 20 bp, Homo sapiens
  source 1..20: mol_type = other DNA
tttatttttccatttaaagg

SEQ ID NO: 201 - DNA, 20 bp, Homo sapiens
  source 1..20: mol_type = other DNA
tattttatttttccatttaa

SEQ ID NO: 202 - DNA, 20 bp, Homo sapiens
  source 1..20: mol_type = other DNA
cttacataaacatacttaaa

SEQ ID NO: 203 - DNA, 20 bp, Homo sapiens
  source 1..20: mol_type = other DNA
taagcacagaagtttttaag

SEQ ID NO: 204 - DNA, 20 bp, Homo sapiens
  source 1..20: mol_type = other DNA
aagtttttaagaggcatgaa

SEQ ID NO: 205 - DNA, 20 bp, Homo sapiens
  source 1..20: mol_type = other DNA
atatttacgtagtttttcat

SEQ ID NO: 206 - DNA, 20 bp, Homo sapiens
  source 1..20: mol_type = other DNA
cgtaaatattcttgagaaac

SEQ ID NO: 207 - DNA, 20 bp, Homo sapiens
  source 1..20: mol_type = other DNA
ttcttgagaaacaggaagac

SEQ ID NO: 208 - DNA, 20 bp, Homo sapiens
  source 1..20: mol_type = other DNA
taatattaaaaacattggtt

SEQ ID NO: 209 - DNA, 20 bp, Homo sapiens
  source 1..20: mol_type = other DNA
ccaatgtttttaatattatc

SEQ ID NO: 210 - DNA, 20 bp, Homo sapiens
  source 1..20: mol_type = other DNA
cctgataatattaaaaacat

SEQ ID NO: 211 - DNA, 20 bp, Homo sapiens
  source 1..20: mol_type = other DNA
cattatcatgcatacatctc

SEQ ID NO: 212 - DNA, 20 bp, Homo sapiens
  source 1..20: mol_type = other DNA
atcatgcatacatctctggc

SEQ ID NO: 213 - DNA, 20 bp, Homo sapiens
  source 1..20: mol_type = other DNA
ttcatttcattttgattttg

SEQ ID NO: 214 - DNA, 20 bp, Homo sapiens
  source 1..20: mol_type = other DNA
attcaatttgaagcagtggt

SEQ ID NO: 215 - DNA, 20 bp, Homo sapiens
  source 1..20: mol_type = other DNA
gaatattcaatttgaagcag

SEQ ID NO: 216 - DNA, 20 bp, Homo sapiens
  source 1..20: mol_type = other DNA
catacgatttaaaatcgctg

SEQ ID NO: 217 - DNA, 20 bp, Homo sapiens
  source 1..20: mol_type = other DNA
aaaatcgctgaggcgcgttc

SEQ ID NO: 218 - DNA, 20 bp, Homo sapiens
  source 1..20: mol_type = other DNA
tttttttttcttttttgtac

SEQ ID NO: 219 - DNA, 20 bp, Homo sapiens
  source 1..20: mol_type = other DNA
ctgttgtcaaagattttaaa

SEQ ID NO: 220 - DNA, 20 bp, Homo sapiens
  source 1..20: mol_type = other DNA
tgacaacagagttctgtttt

SEQ ID NO: 221 - DNA, 20 bp, Homo sapiens
  source 1..20: mol_type = other DNA
agaatacgctgagagttatc

SEQ ID NO: 222 - DNA, 20 bp, Homo sapiens
  source 1..20: mol_type = other DNA
gcaagagaagaaaagaacgg

SEQ ID NO: 223 - DNA, 20 bp, Homo sapiens
  source 1..20: mol_type = other DNA
gttgcaagagaagaaaagaa

SEQ ID NO: 224 - DNA, 20 bp, Homo sapiens
  source 1..20: mol_type = other DNA
atgcacacgtaaaagagagg

SEQ ID NO: 225 - DNA, 20 bp, Homo sapiens
  source 1..20: mol_type = other DNA
aagatgcacacgtaaaagag

SEQ ID NO: 226 - DNA, 20 bp, Homo sapiens
  source 1..20: mol_type = other DNA
atcatgcatacatctctggc

SEQ ID NO: 227 - DNA, 20 bp, Homo sapiens
  source 1..20: mol_type = other DNA
ttcatttcattttgattttg

SEQ ID NO: 228 - DNA, 20 bp, Homo sapiens
  source 1..20: mol_type = other DNA
attcaatttgaagcagtggt

SEQ ID NO: 229 - DNA, 20 bp, Homo sapiens
  source 1..20: mol_type = other DNA
gaatattcaatttgaagcag

SEQ ID NO: 230 - DNA, 20 bp, Homo sapiens
  source 1..20: mol_type = other DNA
catacgatttaaaatcgctg

SEQ ID NO: 231 - DNA, 20 bp, Homo sapiens
  source 1..20: mol_type = other DNA
aaaatcgctgaggcgcgttc

SEQ ID NO: 232 - DNA, 20 bp, Homo sapiens
  source 1..20: mol_type = other DNA
tttttttttcttttttgtac

SEQ ID NO: 233 - DNA, 20 bp, Homo sapiens
  source 1..20: mol_type = other DNA
ctgttgtcaaagattttaaa

SEQ ID NO: 234 - DNA, 20 bp, Homo sapiens
  source 1..20: mol_type = other DNA
tgacaacagagttctgtttt

SEQ ID NO: 235 - DNA, 20 bp, Homo sapiens
  source 1..20: mol_type = other DNA
agaatacgctgagagttatc

SEQ ID NO: 236 - DNA, 20 bp, Homo sapiens
  source 1..20: mol_type = other DNA
gcaagagaagaaaagaacgg

SEQ ID NO: 237 - DNA, 20 bp, Homo sapiens
  source 1..20: mol_type = other DNA
gttgcaagagaagaaaagaa

SEQ ID NO: 238 - DNA, 20 bp, Homo sapiens
  source 1..20: mol_type = other DNA
atgcacacgtaaaagagagg

SEQ ID NO: 239 - DNA, 20 bp, Homo sapiens
  source 1..20: mol_type = other DNA
aagatgcacacgtaaaagag

SEQ ID NO: 240 - protein, 300 aa, Homo sapiens; identical to SEQ ID NO: 12

SEQ ID NO: 241 - protein, 264 aa, Homo sapiens; identical to SEQ ID NO: 13

SEQ ID NO: 242 - protein, 300 aa, Homo sapiens; identical to SEQ ID NO: 12

SEQ ID NO: 243 - protein, 264 aa, Homo sapiens; identical to SEQ ID NO: 13

SEQ ID NO: 244 - DNA, 2397 bp, Homo sapiens; identical to SEQ ID NO: 4
  source 1..2397: mol_type = other DNA

SEQ ID NO: 245 - DNA, 2289 bp, Homo sapiens; identical to SEQ ID NO: 5
  source 1..2289: mol_type = other DNA

SEQ ID NO: 246 - DNA, 1714 bp, Homo sapiens
  misc_feature 1..275: note = Exon 1
  misc_feature 276..383: note = Exon 2
  misc_feature 384..515: note = Exon 3
  misc_feature 516..622: note = Exon 4
  misc_feature 623..760: note = Exon 5
  misc_feature 761..1714: note = Exon 6v4
  misc_feature 878..1714: note = Read-through from exon 6 into intron 6
  source 1..1714: mol_type = other DNA
agacagtacctcctccctaggactacacaaggactgaaccagaaggaagaggacagagcaaagccatgaacatcatcctagaaatccttctgcttctgatcaccatcatctactcctacttggagtcgttggtgaagtttttcattcctcagaggagaaaatctgtggctggggagattgttctcattactggagctgggcatggaataggcaggcagactacttatgaatttgcaaaacgacagagcatattggttctgtgggatattaataagcgcggtgtggaggaaactgcagctgagtgccgaaaactaggcgtcactgcgcatgcgtatgtggtagactgcagcaacagagaagagatctatcgctctctaaatcaggtgaagaaagaagtgggtgatgtaacaatcgtggtgaataatgctgggacagtatatccagccgatcttctcagcaccaaggatgaagagattaccaagacatttgaggtcaacatcctaggacatttttggatcacaaaagcacttcttccatcgatgatggagagaaatcatggccacatcgtcacagtggcttcagtgtgcggccacgaagggattccttacctcatcccatattgttccagcaaatttgccgctgttggctttcacagaggtctgacatcagaacttcaggccttgggaaaaactggtatcaaaacctcatgtctctgcccagtttttgtgaatactgggttcaccaaaaatccaagcacaagattatggcctgtattggagacagatgaagtcgtaagaagtctgatagatggaatacttaccaataagaaaatgatttttgttccatcgtatatcaatatctttctgagactacagaagtaagtacagcacagaacacccaaatactaaaacaccaatagagcttttttttttgctttttttttttttagacagagtctcactctgtcaccctggctggattgcggtggttgcagtggcatgatcttggctcactgcaacctccgcctcctgggttcaagcaattctcatgcctcagacccccaagtaactgggattataggtgtgtgctgccacactacacccagctaatttttgtattttttgatagagacaggtttccccatgttggccaggctggactcgaactcctgacctcaagttatcctcctgtctcggcctcccaaagtgctgggattacagtcatgagccaccatgcctggcccaatagagctattattatggagcatctttcagttgtgaaaattggcatggaaactctccatccctggggagaacagttatttcctctgttattttcctacccagtctataaaaagagagtgattcattttctctaccaaatctactgtctctgcccaaactttgctgaagactattctaactaaaggaaacacagtttaaaaagaatgcaatatagtgaagtagttaataataaagactccatttttaaaagtctgctggaagtttggttgggattgcactgaatctatagagcaattggggagtattgacatatcaacaatattgagttttctaatccaagaacataatatctatttttaaaatcttcttcaaaatctttaaatctttaaattgtattttgtagtttttggtgtttaagtcttgcacatattttgtcagatttattccaaagtatttcacgggttcttttt

SEQ ID NO: 247 - protein, 271 aa, Homo sapiens
  REGION 1..70: note = MISC_FEATURE - Region Encoded by Exon 1
  REGION 71..106: note = MISC_FEATURE - Region Encoded by Exon 2
  REGION 107..150: note = MISC_FEATURE - Region Encoded by Exon 3
  REGION 151..185: note = MISC_FEATURE - Region Encoded by Exon 4
  REGION 186..232: note = MISC_FEATURE - Region Encoded by Exon 5
  REGION 233..271: note = MISC_FEATURE - Region Encoded by Exon 6v4
MNIILEILLLLITIIYSYLESLVKFFIPQRRKSVAGEIVLITGAGHGIGRQTTYEFAKRQSILVLWDINKRGVEETAAECRKLGVTAHAYVVDCSNREEIYRSLNQVKKEVGDVTIVVNNAGTVYPADLLSTKDEEITKTFEVNILGHFWITKALLPSMMERNHGHIVTVASVCGHEGIPYLIPYCSSKFAAVGFHRGLTSELQALGKTGIKTSCLCPVFVNTGFTKNPSTRLWPVLETDEVVRSLIDGILTNKKMIFVPSYINIFLRLQK

SEQ ID NO: 248-250 - skipped (3 entries)

SEQ ID NO: 251 - DNA, 25 bp, synthetic construct
  misc_feature 1..25: note = Synthetic
  source 1..25: mol_type = other DNA
atgaacatcatcctagaaatccttc

SEQ ID NO: 252 - DNA, 25 bp, synthetic construct
  misc_feature 1..25: note = Synthetic
  source 1..25: mol_type = other DNA
atcatgcatacatctctggctggag

SEQ ID NO: 253 - DNA, 20 bp, synthetic construct
  misc_feature 1..20: note = Synthetic
  source 1..20: mol_type = other DNA
atcagaacttcaggccttgg

SEQ ID NO: 254 - DNA, 21 bp, synthetic construct
  misc_feature 1..21: note = Synthetic
  source 1..21: mol_type = other DNA
gcaaagccatgaacatcatcc

SEQ ID NO: 255 - DNA, 24 bp, synthetic construct
  misc_feature 1..24: note = Synthetic
  source 1..24: mol_type = other DNA
tcttgatgtagtgggagtcggatt

SEQ ID NO: 256 - RNA, 82 nt, synthetic construct
  misc_feature 1..82: note = Synthetic
  source 1..82: mol_type = other RNA
gttggaaccattcaaaacagcatagcaagttaaaataaggctagtccgttatcaacttgaaaaagtggcaccgagtcggtgc

SEQ ID NO: 257 - RNA, 76 nt, synthetic construct
  misc_feature 1..76: note = Synthetic
  source 1..76: mol_type = other RNA
gttttagagctagaaatagcaagttaaaataaggctagtccgttatcaacttgaaaaagtggcaccgagtcggtgc

SEQ ID NO: 258 - RNA, 86 nt, synthetic construct
  misc_feature 1..86: note = Synthetic
  source 1..86: mol_type = other RNA
gtttaagagctatgctggaaacagcatagcaagtttaaataaggctagtccgttatcaacttgaaaaagtggcaccgagtcggtgc

SEQ ID NO: 259 - DNA, 20 bp, synthetic construct
  misc_feature 1..20: note = Synthetic
  source 1..20: mol_type = other DNA
ggcagaccgttctcatcacg

SEQ ID NO: 260 - DNA, 20 bp, synthetic construct
  misc_feature 1..20: note = Synthetic
  source 1..20: mol_type = other DNA
ctttaccagtgactccaggt

SEQ ID NO: 261 - DNA, 20 bp, synthetic construct
  misc_feature 1..20: note = Synthetic
  source 1..20: mol_type = other DNA
gtcacagatttccttctccg

SEQ ID NO: 262 - DNA, 20 bp, synthetic construct
  misc_feature 1..20: note = Synthetic
  source 1..20: mol_type = other DNA
agatgatgacgcccaccaga

SEQ ID NO: 263 - DNA, 20 bp, synthetic construct
  misc_feature 1..20: note = Synthetic
  source 1..20: mol_type = other DNA
ggagaaggaaatctgtgacc

SEQ ID NO: 264 - DNA, 20 bp, synthetic construct
  misc_feature 1..20: note = Synthetic
  source 1..20: mol_type = other DNA
tgcgaggaacttacttttcc

SEQ ID NO: 265 - DNA, 20 bp, synthetic construct
  misc_feature 1..20: note = Synthetic
  source 1..20: mol_type = other DNA
agagaaatattgatatagga

SEQ ID NO: 266 - DNA, 20 bp, synthetic construct
  misc_feature 1..20: note = Synthetic
  source 1..20: mol_type = other DNA
tatcaatatttctctgatcc

SEQ ID NO: 267 - DNA, 20 bp, synthetic construct
  misc_feature 1..20: note = Synthetic
  source 1..20: mol_type = other DNA
atcgcttttaaggcacgctc

SEQ ID NO: 268 - DNA, 20 bp, synthetic construct
  misc_feature 1..20: note = Synthetic
  source 1..20: mol_type = other DNA
tatacgactgatcgctttta

SEQ ID NO: 269 - DNA, 21947 bp, Mus musculus
  source 1..21947: mol_type = genomic DNA
gcagcagcccataatacctgacagggctctctgtggagctctgagcagaggtgtctgttgtgagaacagagccatgaacctcatcctggaatttctccttctggtgggcgtcatcatctactcctacctggagtcactggtaaagttcttcattccccggagaaggaaatctgtgaccgggcagaccgttctcatcacgggggccggacacggaataggcaggctgactgcatatgaatttgcaaagcagaaaagcagactggttctatgggatatcaataaggtaataataggtgtttctaacaatcttttaaagtcacaaaataacaaggcatatgtttctctagagacgtaacttagtgctggcttttctctgtgttttcctttttcaaagttttaataaactcctgggtcctttctggatccctgcgacaggtgaacaagatggaaccaacgagctggagaactaagcctggggggtttcattttgtttgactggttggttggttggttggttggttctactgtggtgtacaacttgataacaagagacgcaggagccagagagcttcccagctgctgaaattaggcaagccacataacttacctcaacttcaaatttaaaaaacaaaaaacaaacaaaaaactctaccattgggataaaatctcagagggagacaaaatctacaggtaatgattgccagcaaccaaattggccaatatgcagtttattacagctaggggtgacttttatacttttagattttcatttattctgttattcatttgttcctttctgtgatagactgaagctgggtcttagtacctaccactgagccacagtaccttagcacgtgccaggcaagcactctatcaccgagcaaccgctcaggtttttacacatttgagggattgattctcaaaacaaacaaacaaaaccacatgaagaactaacagcagaaacccatggtacttccactcacactccagcaatcctaaaatacttacatctgaccttttgcagaagaagaaaaaatacttgccgggtcctgagcaagaagggtaaagaataatacttaagtgcttagcatggcctggtgcacgcagcatcacatatggaaatgtctacaccagtgcctggctttcactagtacatttaagaggttgttgatctctgtttatttataaatgctcttaactaccttaagtctgaaagtgttgacgtcctgtgtcactttctcctaaacatgcacattcccaaaaggtcgtgaaaaagatgtgccacaacaaactgtctctgggattgtaatctttgaagaactggactggggatgtagcccagcggtacaacaattatctagaatatacaaactagatattagatccagttgtggctgggtgtgagcctcagcactacaaggaaaccacaaaccgctgctgtcatgtaccggatacagtggctcagactagagagactggggttttggtgtttgtttgtttgtttgtttgtttgtttgttgagaagcagagtttccaaagctttccttggggttttgctcggcttcaggtaaccctctgttacgtttttgccatctgcagttaacaccacttttcccagccttcagaacgctcttgaacataaggagctaaatctgctttggttccttttgagcagtgaagaatcccgagaggcaccatgcatctttgcttagcagatacaggcgttggtgggcaagatgagctaacacggtacttggagatgattctgagattatcaaatcctgcacaggtcccaggcagtcttcttggagctgagaaaactgagtcagctgttctcagtccctcgtaaaaaatataaacgagaatgagaatacatcatgaagatggtccacgggtcttcagatcacctcccaagtgtgcatggtgggaagacatcaatacttagtagactacctttaatttgaaaattttcagacacagaaagagtaaaactagaaagaggtcacattaaagatgacttccactttttttttcctgtgcctgaaaactgagtaactcaaccttgtaaatttctctttgaattcttgaacttcatgatgaaacatttaagacatcaaatgattgactgaaaagctgcaagtgtaactccagtttccctgttcactgagaggccagctagctttccatcaaagaaatatggctccttttccttaaaaggcaagaagcaaggccacagagaagcctcctccacccccagctttaaaaacagtggcacagagatgtgaaacacaactgttaggaagggaattcagcagtggggagggaggggctgcaggaaggtaacaggggataaaataataagagcatacatgtgtatgcaaggaatgaaaagcaaatttaagaagaacgcaatgacacaatagcaaaactgtggacccagccaaggtgcccacccagagacatgggttggaaaatgtggtttcacacacaggacatcgttcagtcttttggaagaatgacatcattctgtttgctggacagtggaaaaaactggcagtcacaactttaggtgaaaagggagccagactcacaaagggaaggatcagtggggggcggggggggggggaggtcactctgctctggtcccagcattggaccaggaaccaaggcaagagggttgctgcaagttagaacccagccctggctacagatgaaattatagcaagagacaaaagagggtaggggaaggcagcaagcatgggctctgtcatgcctcgtgtgtgggaatgtcatcatggaacatactagtttgtacgttaataaaaaggacacagggattagcaatgggcagaggggttgacaccccagaaggtgtttcttgtgcaaaagtgacgaagagatacattcttccatgctccagattaattataaggctggatagttcgcaaattattagcatctatcactcatacatgatgctaggtttcaccgtaagctttcatagatgtgtatattctggtcatattcactgttcacccatcattatctctggtcccctcccactcttgctgaccccctttctaagtgcccccttgtgctttcatgtgtgtgtgctaatgactttagataggattgctaacttgagcctagacgagggcttgttacaggagtagggatggcttgctggtggcgaagaaagtaaccctgatacactgtttcttcagtcacatcttttgcttatgctactgaagaaagtaacactgataaattgtttcttcttcagtcaaatctttgcttgaggctctggttactgcctctctctacagctctgacgtctgtatgaggctagtgaggagggcagctgggccatctgacagtaagcagccttcattagtggaaataaagccaacattagtggaaaactctcctacccagaccacagctctattccacagccccacgaggacctatgctctatgcggcagtccatcccaagtctatgtgaagactatgttggtttcgtaagtgacaccttaaccctccttaaagtctgttctttaagacttctattgttgctttgtggtttagccaagataaggaaatgcaaagggtcggaggggaggcaagcagtgtaagccaaacataccatccactcaggcaaggcccaaatgatggctacactattgccatcccagcttgcacaagaaagagcttcctgggtgtcctcacagagaagtggggacaaccatcagaggaaaaagtgtgatttttaaaaagaatttgaaccccataaaatcaataggtgtcaaaacttggaaagagtccaaattttcctgaaatgtaggttaaaaaaaaaaaaaaagccaagggtagtgactcacacctgtaagtgcttgaggaggttgaggcaggaggattggcctgagttgaagacccgcttagggttcacatagtaagcaagggatagagaatgacacctggtctaaaacaccaagagagaacacacagacacacagacacacacacacacaccacattaggacaatcttaggtaagaggcttctggatttaggctaaaaattagctgtctccatgtcttggaggacttgtgtgcaattctcactttcgtgagaattcagctgttggctcttggcctttttccctccagagcttcagaagaataaatactcagttaagactgtcacgtgtagtaagttacagtttcctcgtgcaagcttttcctggataagattttctcctcgcatccgcgggggtgaatccacgttgtgataagccatctagtgtcactctagagggctgcttagcactctactgccaacaatgggtgatgcccggcaactgtgtggactagtcttccttctgtcctccgtgctcagacatcttccctgacactgtgaggagcagcatcttcgataacttataggaagcccttcatgctaccacagcatgacgctagacaaatcacctacaggcactcccaggacaagatgcgaagctgcaaaagccttaacccgaagggcttgtttctctttgattccgctgctgctttggccagctaattagttaatgtagttagatgagttcacataacgaggcttattggacaaggatccgaaagtattttacagagcctgatcttttctcaaatttgcctcccccctccttcacccctcccgccccccaccccgcccagcgtggtgttgaggaaaccgcggacaaatgcaggaaactgggggccgtcgtgcacgtgtttgtggtggactgcagcaaccgggccgagatttacaactctgtggatcaggtgagaacccgggtgcaggtgtcgcatcagctgacactgagctgggaaacgaaaaggtgggctagggaaggttgacttccggtagacggcagccgccctgtcaagttgctgtgtgaccgaaggagtgaatattaatatccactcagctctggcctctgtcactgtttcatattctgagtcaaatctgctgtgtctaaaaagtttggcccagaggaaacgaaagatgatttatcaagagaaaatttgatctcttttctaacttttttaaaattagactttgttctgctttttctttaacttattccctctgagattttattggtttgcgtataatctagtcttttatgaaaaacagagttaatgactttttaaacattgtatttgttttatttactgcatcgtgtgtgtgtgtgtgtgtgtgtgtgtgtgtgtgtgtgtgtgtgcgcgcgcgcatggtgggggtgtatgtagaatttagatgacaaattttgaaagctggtctctccttccatgatggggattctgggggttgttaggtatggcaaaaacagaagaggaggaggaggaggaggaggaggaggaggaggaggaggtggtggtggtggtggtggtggtgaagaagaagaaggagcaggaggaggggaggaggggaggagtaagaggagaaagaggaaagggaaggggaggggggagggggagaagaaaatgcctttacccactgagccgtctccccaccccacaatacctactctttcaaaaagtgaacatcaagagcttaccaaaaaaaaaaaaacaaaaaacaaaaaacaaaaaaacaaaaaacaaaccctccgctaagctactgccttctttaatctgatttaatttttaaaaatcccattagcctcactatagataagcaaatagaagcttggaaggtttggcccagacaaagaccacgtggccagtgggtagcaaaaccaagattaattacttaacactttaaaaatatcttaacagaacttaagtattatttaccagcacaaacattaattcttgtttatttaagttcataagttttcaccctacctatcacatactgagcacagaatttagggttttaaccaaaacaggttagccctacctcatgacaggtttcccttcctgtcactgcttgggctggttctttcacgcctgaactctgagacctcgtgcactggaataacaaaagcctagatggcatagtgaccaagctagctgtcaccaaagccagtgagcccagacagaaatgcatcgtaaagctattctttattcttggaagtcagatcgatatcttggatatctgtcttccatgtcacgctgtgatgtctgtgtgtctctcattatcatcccttggacaacttcctccttttgtgttattgggctcaggcatttcttggagttgagttggcctagtttatgctggtatcaatcttagactcttgggatggctaggggtagggtgtggagtggttagctcagaacacatggtgtggagttgctgagctataaatattgtgtatgctctggtttctttttacatggtggagtatatatatccttataatatagaacataaaaatgcctctacccatctgtctcctatcaacatgagctttgtgagaatgaccggtcctgtgtgtgcattttaaaaggtaaagagagaagtaggtgatgtcgagatcgtggtaaacaacgccggggcgatatatccagcagaccttcttagtgccaaggacgaggagatcaccaagacctttgaggtcaatatcctcggacatttttgggtaagtcagaaacatttctgggtgtgtgtgtctgacatctcttcggtacaggaaactcattgaggtcacaatatttgtggagggaggtgtttttggttttgtttcttaagatttatttatttatttattttatgtatgtgagtacactgtagctgtcttcagacacaccagaagagggcatccgatcccgttacagatggttgtgagccaccatgaggttgttgggaattgaactcagtacctctgggagtgctattaaccactgagccatctctccagccttgttttttgttttgcaagtcaggaatcttataatgtgtttgaatagaagagccacaggtctctggcaacagggttcagagttcaaggagacacaggacacccaaaagagagagccatttggtttattttgtcaaacaaaatctaacatagggcctgatgaataccagatctacaaaaagtaaattaataataaaaaatttattaattaaaaatatttgtaaaggtttactgatatttcctctgtacatcttttcactattttagaggaaatgtatgctgcatacattggtctgcatcttcctttcataggtgtttagagctgaaaggacatagaatacttagatttgtgcagaagttggggacacttagagttaggctctgagataagtagacattttgacataacattattatctacaaagttcctgcctgagaacttcacaattgagttaccaataggggggggaaacaatctcaaaatgttttactgtagctcacaaatttgcattgatctatattcccagctaatctcagtcataagcagcctatgggcggtgggatgagcatgcctattagttctggagtgtagagagaatgaatccaattccttactattgggagtttgtgagaaactgaagtacccttctcagccctttggagggagcatttgtatgaattaataccgtgggacctcaaaattactatagcacctggagcaaacctggatttgaagaacatccttcatcctcatgacccagctaacatgacagtcacacaacacagggaccctatatactagttatctaataattaataggaaattataactatgtcacaaaatatatcaaaaggtagaggtttagagaaccaggagccctcattacctccatacagatctgcaggcagggctgatagggggattatcttggcaacctgggctctaggaatttacacagaatttgaagagtgggtctgtaaaattctcataaaatgttctgatatttcccactgtacagtgaggcttttgtttcccataatgtatcctatactgtatactgttacaagagagagatttgggtctgctccctgtgcacggtggttgtgggccaggatagagcttccaccgctttgacgtgagtaaagatccccattcttcaaattggagccaagaacttgtaaaacggtaaaccatcctccagttcccgcactggtggatctctcccttgacaatattgcttagggctcagcagcaccaggcttgcctggcatgcacaaagtcctctggttaattcctagcacggcggaaaagtaacaatgttgcttctgtggcaaatcccggaaggagctacttaattcttcctggagggatgaaggggcatgctcgcccgctagcactggtcctcagcacaatctaggggactcagctctgagtgctgtatgcacgcttgcacaggtcctctgcatgatctaagggacactctgagtactgcctggaaccatcacagttactctctctttctgtcactgtgtggaaggaacctcagggtcttacaagtgtgtaatttccaatgcctcctcctccgctatggtggaggcattggaaatgaaagagcctggcctggaatccacctaataaccgtgtcattgtttctgttctttttacgtggaccttaagatcataaaagcactccttccatcgatgctgagaagaaactctggccacattgtcacagtggcttcggtgtgcggccatggagtgattccttatctcatcccttattggtaggtgtctcttgctcacagcgctgtgcatttctgcttattagtttggggattatttatagggattattataattagtatatttatgtgttttataaatattatatactataattttataaatgtattcatatattatataactaaataattatagggattaattataggaaattattagggattattagttttcaggcctcaatgcccacagcctagtaaagtgcccagaagctaacacaagcacagaggtatagcgtggtctatgtgtgtgcatgtgtgagagaagagaacggagcagccctgccttcccaggagatgcacacactgcacaccatgtcccagggacccagacacactcgcagtctgcagcatatccctgagaagtctgctattgccatcttgtttccttactgctatacgatgatctcagaaacacttttaccaagatctgtggatgtagcagatgcaggtgttatttctttataggcatattcaaagctaaacttgaccatggactaagcaatctctcacactatacatggtcacagatgagttaaatttcagtgtagttcaggtttccattacacgcacacactcacacacatacacatacacacacaatacacacacatgcacacacatacaccacacacaccatacacaacacatacacacacaacacacattcacatatgcacacacatatacacacacacacatcacacatgcacacaggagaggaagacagagacagcaataacttctaacactgatattttttgtcacctggacaaaaactacaattaaaacttatatagctccatatatgcatatgctaatttattgaattctccaagacagccttatattttgttatctatattttataatcagaaaaatgaaagaacaaaaggttaaaggttgcacatgcaaacacaaccctaccaatgccatctggagcccctttgctccaaatactcgttgtgacattaggacacacatgagactgccagtgtcaagggagaaaacatcagctctttaatcaagagaagagaaatgagctcagacccacaagtttgtcgatgttggtttcacagtgttttaagtgtgtttttctgactcacatttttggagataaaaactaataaaacctgattaagaagcacttggaaggttgcctggaccatagagaagggtcacacatacagtgagaaacattaagcctatctgtaaagtggtccttttgctatctttgctagttagaagttagaaacaggggctttggggttagcaatggttgaagacatgcatgtgtcaatccctgagttcaatccccagcacctaaaagaaaaaaggaaaaagaaacaggtattttgcatgctcagaattctgcttcctacataagaaaataaactcgagcggcaggtgacaggtctggacacatgaagctgccttctctcaggcagctgagactgtccccaccaccaccaccaccaccaccaccaccacacacacacacacacacacacacacacacacacacacacacacacacacacctttgctgatggctgattttctcacagctccagcaagtttgctgctgtgggcttccaccgagcactgaccgcagaactggacaccttggggaaaaccggtatccaaacctcgtgtctctgccctgtgttcgtgaatactggcttcaccaaaaacccgagtacaaggtgagatggaagacctttaagcgggagcccccccctccaggcaatggagtcttgagtaggtcataggtacttaacaagcatgtcacgatcatttaaataagtccagtagcatgatctcaacccctaggctgacactgaggtgcccatgtcagatgtggctctaaggctggattgaagactccattgcaaaattaggaaggggagagacagaggcaggataatctaaaaagaattgatttgtgctgctgtgtgatggtttgctagtccacatcacaggcatcacaatcgcacgggagtctgcggaaaccacagactatctcatgggattcagttccaacacccacacagccttgcctcggcatgctaaccttggtgtgacatctaaaatccatttttatgctttgatttttccctcctcttcattaatgggcaaggctccaacactggacatgggttatacgcatttctcagttatacacgggtgcaacttttgaatcacgaaacgccccagtgctgtaacagaacactccttgtacaaatcttaaattcccataaaattgcaggagaagcaaatcttagtacgagatgcctcagaacaactcagctctgtggatacccacacacaacgggaagtgtactcagacatagaatattctttttacatacagcaggcattggagatccggtgtttccttcctggccattttgtcccctggctcctcagtccctccccatcttgtaccttgttgtgatttaattattttgacctggtgaggtaacagacagacctactggacccaagagtacaagaacatgataacaagttatcagtgtgggatgtgggaaggggagagggtgatgttcactcagggaagcctggaacattgtaaatcctaattctaaatttggtgaagagacaggataatttccttcatttgttaattaaaaacaatataaatcaagaggctggggttttacctcaacatcagggtatgtgtgaaagttctggatttaattccagcatccaaaggaagaaataaaatataaacggagataaactctttccccctttccttcaggttatggcctgtattagagccggaagaagttgcaaggagtctgatcaatggaatacttaccaacaagaaaatgatcttcgttccatcctatatcaatatttctctgatcctggaaaagtaagttcctcgcagaaccctgaaacactcaaacacaaatgttagaaatgttgctatggaaactccccatggctgcagtgaaagtcacgttttccatgttgccttacccatgagtctttgattccctgataccctttctggaatacatctaccatcttggcccaaattttgttcaagtctatttaacagaaagaaagaaaaactacagggtatgggcacaccataaaggctctgtgtgtgtgttcatgtggtgtatgtgggggatagagatgtggtacttgtggagacagaggcaaagctctcaggaaccatccacctaggtttctgatttgggtttatttctcttctctccttcccctcccctcccctcccctcccttcccctcccttcccctcccctcccctcctctcttccttttcctttcctttcctttccttttcttttcttttcttctcttctcttctcttctcttctcttctcttctcttctcttctcttctcttcctcttccttccctccctccctccctctctttcctctctctctttttttctgatacaatctcttattgagacctggactcaccagcttggctaggatagatatgcatcaccagggatatcccaggccctctattcccacagtactggggttacaagtgctgacagctatgcccagctgtgtgtgtgttctgaggattgaactcaggccctcctgttgtcgtggcaatctccctaaaccctcgggtgctcagttttgcagttctttgtgacagtgtgcatctcgaatgtctcataacatgctttcacatgtttctatttcacttcatttataacccaagagccttatgatagaatcacttcttttcatctcaggcttgtgagcccccaaagagggcaaaatcccacaaattgaatttcctcaacacagctcaaaacaggtctcattaaaagttgaaaaaaaattccaaaattggcatgtatatgaccaaagtgcaaaaatggttgactgctctgcctgggataggaccagttacctgtctcaaagcccttgccacactgtgggtgatttgttacgctggcaacagggatttttgttgctccttgcatttaactccttttggagagagacagttctgtgatcagaagcaatcactagtctctgggcttgttgttcaatggcctgagcaagctctctccttaccacctcacagcagggtccccacctcccagtctcttctcccaccttctgccctctatccagggaagtaaatgttgctttagtaaacaataccaatgtgatctgaaatttggctttctctgtagaaatcgcacctcctgcctctttcacttcactcacacccttccctattctgtcaactcagacctaaccctccgacatgctgagaggtattcagcccctgtaaacccttccttccacatcttgttatagtcagctgatggttttctgtattcatttccagttggccatgtttaaccgctgggcagcgcaatacactaagaggcagtagcttttgaaaaggctctttagtttttctttctctaaaataataggtctggacacaggcagaggggggaagggggtgtatgtggtggactctcagttcttggccccagaatacactgccgttttttggaagtgagcttggtgtcggttttaggttgtcattggtagaagacgtcatccaattttgctgttctgagagaacaacgctatattatatatagataactgtagatggggtgggggaggggagactaaacaataagcaaagagtagaggaaaactggacttgagtaagtatgctcttggcgctttttaaattgacaacaaaaaggaacactggcatcaaaacttcaaactgaaatttctcattttatttttaatgtaggtttcttcctgagcgtgccttaaaagcgatcagtcgtatacagaacattcaatttgaagcaattgtgggccacaaaaccaagatgaagtagtgcatgcagagacgtgtggacaccaatgatgtgaagccaagtttagaggggacacacagctttctttcacatgttttaagtgttccacatgtttaaaatgtaggcttgaccctagcagccatcgagtgcataagcgtggtcaactgtccttctagtttcctatacttatagatgtctcagctcctggtagtgggttctggcaatggatatgtaaaggagggaaaaggcaatccatgtgtttttataaaataaattactaaatagaaatgtgggcaaaagggcaagataataaagtcttgggcaaatgttggcacgctgtagtgatttctctttcgatggagagattggtggtgttttaaatttgctctttgtggacaggatgaaaactctacctggtttccttgacatatgaattaggaaggagtatttttgttccacattttttttctcagtgtgaggttttcttcacatcatgtgaatggacaatgaggtcattttatttacctaacttggggaagcaaatattgacacagatttgcaactgtgaaatctcaacaccttgttctttgctttagaaagaccttggacacatttgtttttctttttattctattaggcaataactgaaaatacccaaccgtatacatagtaacagtgacatgacctcccacacagatcccattatgaagcaggaaaccttcctgggttttcctttggcttctgtattttgctgcaggggactgatcccacagactaagacaggttacataggcagtctgtgttgacctcctgtctatcaacttgcagagttacttccacattttgctttgatacctttaaagtgaagctcagagggatgcctcagtatgtgacaatgatctcttttgcccacgtctgcatattttgagtgtaaatatcttccctacaaggtccagctccatttctaaatatttttctatgataatcttcacagtcacagttctcactcctgctaaccattgcagccgcttaggctaccccaggaagcacagatccctaagtaagaccccatctacacaaatcatttagttagagacacatcatagaattcctaggtccctgcgagcacggggtcatgatttattgatgagtatttcagaatggtggaagtatttgtttattgtctactcagttcatggaaacaacctttttggtaagcagacagtatctcctcttttttttaatggtagaatatgatattgcatatacataagcacattttgaacatagctgaatataagtatcactgtttcatccttcttcttcttcttcttcttcttcttcttcttcttcttcttcttcttcttcttccggagcatataattttattgctcttcttttttaaagaatagaagaatatcttttatactaggtccatgggctatctagtgtctggtttttgttcacccaagcagtgctagatacaagctccatcttgtgtagtaggctttaagtcaaaacagatttggttggttactctcacaacattgggctaccattttcctaccatatcttttaggcacaacaccaatgttgatccatgggtgtgtggctttgtttgttgttcttttcctaggagcatgcagaatgacttcctacacctaagatactagtagataggagtgaagagtctatgtagtcaccagattgacttctagatgttcagtgagttgagttgcctttagcaataggaccttgttgacaggtggtgtagagaaacatatggccatggtaacagcttgagttctttgcagattcccatgtaaacatttggacaacatctcagtaaaatgtaattgagtttgaatactggaagcttcttttggtgaggaaagataccctgttagaaacaagtctcctttgttatagggtgatttcatttatatgtgtaattgcctttgtatgtgtatatttttctatcaatctgtctatgtatcatctatctaatctctctgtcatctaatatatgtatcatctgtcagttatccacctatcacacatatatagctattgtctatcaatcaccttttaatctaccttttcattctatcaaactattaatatatcaatcacttatgtatttgtgattgatctatcttttaaccatctaattatcacatatctttcttctattgatgatctattttcatctgtttctctgtctgcctctcatttccttttgaatagctctagctatcatatgcaaagggaagacattttcacaaaaataagcagtcttgagggtcctcatgatgttttcagtccctcagtgtctcattccaaaagcccaaagacaccatagaattcagacagaatgccatgtaacaaagccccacactcaatacccagttacaaccaccttagcagaacactaaagagattaaactatccttggctgccactaaaatcaggtagtcttcatggtaagtgtggatctagcttttggggaagtcctgtattctttgctaacccactttcatttcaagattgaacaaaacacaggaagatggtgccctgtgaggccttgacactcacatagcctcagtccagttagctccctgtccatgtgttcacaacagatgcttgtgataaagaaagccccacaggatgggtgaggtctgagtttctgaccacagatccttcctgttatttttgatgttatttttatgtttgtgtggttatcttcttttgggtttgttgaaagaggatttctttttctttttctaaggtgtagtttcccttcttgtgttggcattttccatctattatcctttatagggctggatttgtggaaagatattgtgtaaatttggtttgtcatggaatatcttggtctctctgtctatggtaattgagagttttgctgggtatagtagcctaggctggcatttgtgttctcttaggatctgtatgacatctgcctaggatcttctagctttcatagtctctggtaagaagtctggtggaattctgataggtctgccttttacttgaccttttccccttactgcttttaatattctttctttgttttgtgcatttgatgttttgattattatgtgacaggaggaatttcttttctggtcaagtctctttggagttctgtaggcttcttgtatgtttatgggcatctctttctttagattagggaagttttcttctataactttgttaaagatatttactggccctttaagttggggatcttcactctcttctatacctattatccttaggtttggtcttctcattgtgtcctggatttccaggatgttttgggttaggagctttttgctttttgcattttctttgactgttgtgtcaatgttttctatggtatcttctgcacctgagattctctcttctacctcttgtatactgctggtgatgcttgcatctataactactgatctctttcctaggttttctatctccagggttgtccctttgtgatttctttattgtttctatttccattttcagatcctggatagttttgttcaactccttcacctatttggttgtgttttcctgtaattctttaagggagttttgtgtttcctctttaagggtttctagacatttacctgtgtttctttaaaggagttatttatgtccttaaagtcctctatcatcatcatgagatgtgattttaactcagggtcttgcttttctggtgtgttgggatatccagggctcactgtgttgggagaactgggttctgatgatgccaagtagccttggtttctgttgcttatgttcttgctcttacctcttgccacctggttatctctggtgttaactggtctggctgtctctgactgtggcttgtcccttctgcaagtctgcattgttagtacttctgggagaccagttctctcaggaggaatttgggtatggagatctgtggcacagggtcagctctggagtgtagacagaaaccagaaggatcctgtgcctggttgttccttgattcctgtgtcctgatggctctgggaaggtttcgcttgggccacgagtttgaacagaagtggtgctcttacctgtgctcgggggtgtgtcagcactcctggcaaaccagctctctcctggccgtatttgggtatgtagcggtgtggcacaggatcagctccgggcacagacgcaaaccagaaagcttctgtcccaggccgctcctggttcctgtgtcctgagagttccaggagggtccttctgagcagcagtggtggttttacctgagttcaaaggcttgtccacactcctgggaggcaagctctctcccagcactatttgggtatggagccctgtggcagaggatcagctctgggccaaacataaaccggaaggctgacatctttcaaaaggagtctttttttctttctttttttttgggggggggggggttgatttttttttttttcgagacagggtgtctctgtatagccctggctgtcctggaactcactctgtagaccaggctggtctcgaactcagaaatctgcctgcctctgcctcccgcatgctgggattaaaggtgtgcgccaccacgacccgctcaaaaggacttaatgttctttatttaacaatgttatatattttctagcaacctatcttctctccctctctccctttctgcttctctctttcttcctctttctttttctgcacctttctctctctgcctctctctcttcctttctctctgtctctgtctctctctctctctctttctctctctctctctctctctctctctctctctcgtgtgtgtgtgtgtgtgtgtgtgtgtgtgtgtgtgtgtgtgtgtgtattaaaggctgcattacaccaggcaaaggctgtgttacaccaggtaaaggctacattacacaggtaaaggttgtgttatgccaagcaaaggagtttctttgaactttaatctcattgcacccacaagagagtaagcatacctcaggctaggtgtgttcactggaatacgtgaagtaaaggttgaaacttctgtttatgactaattctttatcttaaaactttgttttttacagtatatacgatatgtgattatattatgacacgatatatactaagtaaatattaggtacacactgaagtttagctgcaatgctcagtcagacccacagtcctttgcccactcctgttctctctctctctctctccctctctgtctctctctctctctcgctctgtactctatagctgtctttgagcaaagatcacaggaaccaaaaaactgagaggtccagagcatgagcctagtgcacattttagtattcctacatggttataggtgcactgtctcctgtccatggtgtctaccaccctaggaaaagctgcagggtctagagatcttagaaatagaataagccaggctaaatacacagaccactgggtaaatcagtgcagtggtcactgttgtgggctagtcaccagagaagactgttcaagccaatggaaagtcattactagctgactggtgactacactggatgttcaggatcccagtgtagcactgagccttcctcaggttgagcttttaagcacaaaaaccatgttcttggttgacgtacttcagttaacaagaacagttagctggaagaggaactacagaagctaaaaggcaacattagtacattatgagactttaccaaaacaatgaaccctaatgaattatgccttttagttttgacaggtagggctgtctaagtgctgagttttacagcctgaacagtacttccatcatggagtcagatatgctaagatctgggaccctgttacattccacactgttcttagtgaatgagtcaaatcatggattcatcctgttttagtttaagatgaagaatgagaattaaagtgctgacacaaaatcattagccagggagaccacgagaatggagactggtactgactacttcctcaaccatgtctatattttctctaattattccttaccaattagtatagaaacaataggtttctttcagagccatgtatagtttcctttatgtcatttgaagtctaggcctctccaattttgtagggagaatctacctgcaagggaatctaactgttgttttaattcagaaactgaaacttcaaatacctgtaggtcctgatcaacctatcctcttagtttggaaagcctcagaagaggcatatttagtcaaaccattaatatatgctcaccaagtagtctcagaggtttggtaatattgctgttgtccagatgaattaaaccatcgggcagaataacacaccttggaatgtggggaagtgcgtaggttaaaaattttggatattagacaggttttagccccttctaagtcctctagcattaatctgggctgcccccagtcacagtgagttttgtcagtcaatagattggttagtccccatttctctgtcctacagcagatgggtgtctaagcagtttcatcaaccctggatggttttgactgggcatgattacctctgcctcccagggactctttctgtggcatagagtctgatgctccaggcctttttggttttacaaagaccagaatcttttaaagagttttgggggcctagtgagatggttaagaacactgactgttcttccaaaggtcctgagttcaattcccagcgaccacatggtgggtcacaaccatccgtaatgagatctgacaccctcttctggtgtgtctgaagacagctacagtgtagtgtacttagatataataataaataaatctaaaagaattttctgtaggaagcttcggttttaagttccaatttttggaatggaaactcctctgttttaagctgtggtacagggtcagctctggggttcagacagaaaccagaaggatcctgtccccaactgttctttggttccagtgtcctgatggctctgggcatgtccctcttgggccaggaatttgagcagaaatggtggtcttacctgtccacactcacaggcatgtccacactcctgggagaccagttctctcctggtggtatttgggtatggagcgctgtggcacaggatcaagctctgggtacaggcggccagtatctcctctcgtttgatcctgaattgttaaattctttattatcaaataaaccattcttggccaatcttgtggccacactgaatgccagtagtaaggagcctatgaacatctgacatcactgtgcaacaataaaagacggcaccatgttcagacataaccaatggaattggattcatagatgtacacatgtggagtgaagatcaatagtccagagccagaagaggaccagaggccccagcaacattgctcccagacctgctaacactttggtttcctccatacactgctgaacaagagagtacttactccagaaagctatgagctgggtgatgaggagagggctcaggttttaaaagcacttctctttctttcagaggacctggattcagttccaagcacccacatggtggttctcaacagcctgttactccaatcccaggggatttgacaccctcttcagactttctcaaacactaggcactcgtggggtacgcatacgtcattcaggcaagccctcatacacataaaatagaataagcacatattttaaatgtgctactattactgatgttttaagccagttaaattatgtgattttcttaacagcaataaaatattgtagataatgtcatcatgctagctgcatcactctgactgtataaacccaagagaatttcactccatctccttctgccaaaatatttacaacacttaagaaataagggctgatttttattttttttaacataaaatatatgagacagttgtatcctgtcagctaaaaatgttttctctggcctgtgagttggctcagtagatgaagacacttgctgccaagcctaacaacctgaattcaactcccagaacccatgtaatgggaagacagatgggattcagagaaattgtcctctgatcattgtacccatgccttggtatatgagtatctgtgatggtttgtatatgctcagtccagggagtggcactactagaaggtgtggtcctgttggagtagatgtatcactgtgggtgtgggctttaataacctcatcctagctgcctggaagccagtattctgctagcagccttcatatgaagatacagaactctcagctgtgtttgcaccatgcctgcatgaacgctgccatgctcccaccttgatgataatggactgaacctctgaacctgtaagccagccccgattaaatgttgtcacttataa

SEQ ID NO: 270 - RNA, 36 nt, synthetic construct
  misc_feature 1..36: note = Synthetic
  source 1..36: mol_type = other RNA
tgtcaggttagttagatgaagttttagagctatgct

SEQ ID NO: 271 - RNA, 36 nt, synthetic construct
  misc_feature 1..36: note = Synthetic
  source 1..36: mol_type = other RNA
gtgtcaggttagttagatgagttttagagctatgct

SEQ ID NO: 272 - RNA, 36 nt, synthetic construct
  misc_feature 1..36: note = Synthetic
  source 1..36: mol_type = other RNA
cctgacacatatacagactagttttagagctatgct

SEQ ID NO: 273 - RNA, 36 nt, synthetic construct
  misc_feature 1..36: note = Synthetic
  source 1..36: mol_type = other RNA
ctgacacatatacagactaagttttagagctatgct

SEQ ID NO: 274 - RNA, 36 nt, synthetic construct
  misc_feature 1..36: note = Synthetic
  source 1..36: mol_type = other RNA
ccttagtctgtatatgtgtcgttttagagctatgct

SEQ ID NO: 275 - RNA, 36 nt, synthetic construct
  misc_feature 1..36: note = Synthetic
  source 1..36: mol_type = other RNA
catatacagactaagggaccgttttagagctatgct

SEQ ID NO: 276 - RNA, 36 nt, synthetic construct
  misc_feature 1..36: note = Synthetic
  source 1..36: mol_type = other RNA
atatacagactaagggaccagttttagagctatgct

SEQ ID NO: 277 - RNA, 36 nt, synthetic construct
  misc_feature 1..36: note = Synthetic
  source 1..36: mol_type = other RNA
tcaaagtttgataaattcccgttttagagctatgct

SEQ ID NO: 278 - RNA, 36 nt, synthetic construct
  misc_feature 1..36: note = Synthetic
  source 1..36: mol_type = other RNA
aaaatacaaagataagtagagttttagagctatgct

SEQ ID NO: 279 - RNA, 36 nt, synthetic construct
  misc_feature 1..36: note = Synthetic
  source 1..36: mol_type = other RNA
actctgtgactttaaaaagtgttttagagctatgct

SEQ ID NO: 280 - RNA, 36 nt, synthetic construct
  misc_feature 1..36: note = Synthetic
  source 1..36: mol_type = other RNA
ggttctgtgggatattaatagttttagagctatgct

SEQ ID NO: 281 - RNA, 36 nt, synthetic construct
  misc_feature 1..36: note = Synthetic
  source 1..36: mol_type = other RNA
acagagcatattggttctgtgttttagagctatgct

SEQ ID NO: 282 - RNA, 36 nt, synthetic construct
  misc_feature 1..36: note = Synthetic
  source 1..36: mol_type = other RNA
gacagagcatattggttctggttttagagctatgct

SEQ ID NO: 283 - RNA, 36 nt, synthetic construct
  misc_feature 1..36: note = Synthetic
  source 1..36: mol_type = other RNA
tgcaaaacgacagagcatatgttttagagctatgct

SEQ ID NO: 284 - RNA, 36 nt, synthetic construct
  misc_feature 1..36: note = Synthetic
  source 1..36: mol_type = other RNA
gagctgggcatggaataggcgttttagagctatgct

SEQ ID NO: 285 - RNA, 36 nt, synthetic construct
  misc_feature 1..36: note = Synthetic
  source 1..36: mol_type = other RNA
actggagctgggcatggaatgttttagagctatgct

SEQ ID NO: 286 - RNA, 36 nt, synthetic construct
  misc_feature 1..36: note = Synthetic
  source 1..36: mol_type = other RNA
ctcattactggagctgggcagttttagagctatgct

SEQ ID NO: 287 - RNA, 36 nt, synthetic construct
  misc_feature 1..36: note = Synthetic
  source 1..36: mol_type = other RNA
ttgttctcattactggagctgttttagagctatgct

SEQ ID NO: 288 - RNA, 36 nt, synthetic construct
  misc_feature 1..36: note = Synthetic
  source 1..36: mol_type = other RNA
attgttctcattactggagcgttttagagctatgct

SEQ ID NO: 289 - RNA, 36 nt, synthetic construct
  misc_feature 1..36: note = Synthetic
  source 1..36: mol_type = other RNA
ggggagattgttctcattacgttttagagctatgct

SEQ ID NO: 290 - RNA, 36 nt, synthetic construct
  misc_feature 1..36: note = Synthetic
  source 1..36: mol_type = other RNA
gaggagaaaatctgtggctggttttagagctatgct

SEQ ID NO: 291 - RNA, 36 nt, synthetic construct
  misc_feature 1..36: note = Synthetic
  source 1..36: mol_type = other RNA
agaggagaaaatctgtggctgttttagagctatgct

SEQ ID NO: 292 - RNA, 36 nt, synthetic construct
  misc_feature 1..36: note = Synthetic
  source 1..36: mol_type = other RNA
cagaggagaaaatctgtggcgttttagagctatgct

SEQ ID NO: 293 - RNA, 36 nt, synthetic construct
  misc_feature 1..36: note = Synthetic
  source 1..36: mol_type = other RNA
tcctcagaggagaaaatctggttttagagctatgct

SEQ ID NO: 294 - RNA, 36 nt, synthetic construct
  misc_feature 1..36: note = Synthetic
  source 1..36: mol_type = other RNA
tgaagtttttcattcctcaggttttagagctatgct

SEQ ID NO: 295 - RNA, 36 nt, synthetic construct
  misc_feature 1..36: note = Synthetic
  source 1..36: mol_type = other RNA
cttcaccaacgactccaagtgttttagagctatgct

SEQ ID NO: 296 - RNA, 36 nt, synthetic construct
  misc_feature 1..36: note = Synthetic
  source 1..36: mol_type = other RNA
ctactcctacttggagtcgtgttttagagctatgct

SEQ ID NO: 297 - RNA, 36 nt, synthetic construct
  misc_feature 1..36: note = Synthetic
  source 1..36: mol_type = other RNA
ctccaagtaggagtagatgagttttagagctatgct

SEQ ID NO: 298 - RNA, 36 nt, synthetic construct
  misc_feature 1..36: note = Synthetic
  source 1..36: mol_type = other RNA
caccatcatctactcctactgttttagagctatgct

SEQ ID NO: 299 - RNA, 36 nt, synthetic construct
  misc_feature 1..36: note = Synthetic
  source 1..36: mol_type = other RNA
tgatggtgatcagaagcagagttttagagctatgct

SEQ ID NO: 300 - RNA, 36 nt, synthetic construct
  misc_feature 1..36: note = Synthetic
  source 1..36: mol_type = other RNA
tcagaagcagaaggatttctgttttagagctatgct

SEQ ID NO: 301 - RNA, 36 nt, synthetic construct
  misc_feature 1..36: note = Synthetic
  source 1..36: mol_type = other RNA
gatttctaggatgatgttcagttttagagctatgct

SEQ ID NO: 302 - RNA, 36 nt, synthetic construct
  misc_feature 1..36: note = Synthetic
  source 1..36: mol_type = other RNA
ttgctctgtcctcttccttcgttttagagctatgct

SEQ ID NO: 303 - RNA, 36 nt, synthetic construct
  misc_feature 1..36: note = Synthetic
  source 1..36: mol_type = other RNA
aggactgaaccagaaggaaggttttagagctatgct

SEQ ID NO: 304 - RNA, 36 nt, synthetic construct
  misc_feature 1..36: note = Synthetic
  source 1..36: mol_type = other RNA
tacacaaggactgaaccagagttttagagctatgct

SEQ ID NO: 305 - RNA, 36 nt, synthetic construct
  misc_feature 1..36: note = Synthetic
  source 1..36: mol_type = other RNA
ttcagtccttgtgtagtcctgttttagagctatgct

SEQ ID NO: 306 - RNA, 36 nt, synthetic construct
  misc_feature 1..36: note = Synthetic
  source 1..36: mol_type = other RNA
tcagtccttgtgtagtcctagttttagagctatgct

SEQ ID NO: 307 - RNA, 36 nt, synthetic construct
  misc_feature 1..36: note = Synthetic
  source 1..36: mol_type = other RNA
gtccttgtgtagtcctaggggttttagagctatgct

SEQ ID NO: 308 - RNA, 36 nt, synthetic construct
  misc_feature 1..36: note = Synthetic
  source 1..36: mol_type = other RNA
cttgtgtagtcctagggagggttttagagctatgct

SEQ ID NO: 309 - RNA, 36 nt, synthetic construct
  misc_feature 1..36: note = Synthetic
  source 1..36: mol_type = other RNA
ctcctccctaggactacacagttttagagctatgct

SEQ ID NO: 310 - RNA, 36 nt, synthetic construct
  misc_feature 1..36: note = Synthetic
  source 1..36: mol_type = other RNA
gtagacagtacctcctccctgttttagagctatgct

SEQ ID NO: 311 - RNA, 36 nt, synthetic construct
  misc_feature 1..36: note = Synthetic
  source 1..36: mol_type = other RNA
tactgtctacacagagctctgttttagagctatgct

SEQ ID NO: 312 - RNA, 36 nt, synthetic construct
  misc_feature 1..36: note = Synthetic
  source 1..36: mol_type = other RNA
actgtctacacagagctctagttttagagctatgct

SEQ ID NO: 313 - RNA, 36 nt, synthetic construct
  misc_feature 1..36: note = Synthetic
  source 1..36: mol_type = other RNA
tctacacagagctctagggagttttagagctatgct

SEQ ID NO: 314 - RNA, 36 nt, synthetic construct
  misc_feature 1..36: note = Synthetic
  source 1..36: mol_type = other RNA
ctacacagagctctagggaagttttagagctatgct

SEQ ID NO: 315 - RNA, 36 nt, synthetic construct
  misc_feature 1..36: note = Synthetic
  source 1..36: mol_type = other RNA
tacacagagctctagggaaggttttagagctatgct

SEQ ID NO: 316 - RNA, 36 nt, synthetic construct
  misc_feature 1..36: note = Synthetic
  source 1..36: mol_type = other RNA
ggggtgtgcccagttgttaagttttagagctatgct

SEQ ID NO: 317 - RNA, 36 nt, synthetic construct
  misc_feature 1..36: note = Synthetic
  source 1..36: mol_type = other RNA
gggtgtgcccagttgttaatgttttagagctatgct

SEQ ID NO: 318 - RNA, 36 nt, synthetic construct
  misc_feature 1..36: note = Synthetic
  source 1..36: mol_type = other RNA
tggtagtcccattaacaactgttttagagctatgct

SEQ ID NO: 319 - RNA, 36 nt, synthetic construct
  misc_feature 1..36: note = Synthetic
  source 1..36: mol_type = other RNA
ctggtagtcccattaacaacgttttagagctatgct

SEQ ID NO: 320 - RNA, 36 nt, synthetic construct
  misc_feature 1..36: note = Synthetic
  source 1..36: mol_type = other RNA
ttgttaatgggactaccagagttttagagctatgct

SEQ ID NO: 321 - RNA, 36 nt, synthetic construct
  misc_feature 1..36: note = Synthetic
  source 1..36: mol_type = other RNA
taccagatggaagccagcttgttttagagctatgct

SEQ ID NO: 322 - RNA, 36 nt, synthetic construct
  misc_feature 1..36: note = Synthetic
  source 1..36: mol_type = other RNA
ttccaaagctggcttccatcgttttagagctatgct

SEQ ID NO: 323 - RNA, 36 nt, synthetic construct
  misc_feature 1..36: note = Synthetic
  source 1..36: mol_type = other RNA
tggaagccagctttggaagcgttttagagctatgct

SEQ ID NO: 324 - RNA, 36 nt, synthetic construct
  misc_feature 1..36: note = Synthetic
  source 1..36: mol_type = other RNA
acaaggcctgcttccaaagcgttttagagctatgct

SEQ ID NO: 325 - RNA, 36 nt, synthetic construct
  misc_feature 1..36: note = Synthetic
  source 1..36: mol_type = other RNA
gccttgttcacgtgttctaagttttagagctatgct

SEQ ID NO: 326 - RNA, 36 nt, synthetic construct
  misc_feature 1..36: note = Synthetic
  source 1..36: mol_type = other RNA
ccttgttcacgtgttctaatgttttagagctatgct

SEQ ID NO: 327 - RNA, 36 nt, synthetic construct
  misc_feature 1..36: note = Synthetic
  source 1..36: mol_type = other RNA
cccattagaacacgtgaacagttttagagctatgct

SEQ ID NO: 328 - RNA, 36 nt, synthetic construct
  misc_feature 1..36: note = Synthetic
  source 1..36: mol_type = other RNA
ttggcatcacttcatatttggttttagagctatgct

SEQ ID NO: 329 - RNA, 36 nt, synthetic construct
  misc_feature 1..36: note = Synthetic
  source 1..36: mol_type = other RNA
cttgtgctcttggcatcactgttttagagctatgct

SEQ ID NO: 330 - RNA, 36 nt, synthetic construct
  misc_feature 1..36: note = Synthetic
  source 1..36: mol_type = other RNA
agcacactctcttgtgctctgttttagagctatgct

SEQ ID NO: 331 - RNA, 36 nt, synthetic construct
  misc_feature 1..36: note = Synthetic
  source 1..36: mol_type = other RNA
gcacaagagagtgtgctctcgttttagagctatgct

SEQ ID NO: 332 - RNA, 36 nt, synthetic construct
  misc_feature 1..36: note = Synthetic
  source 1..36: mol_type = other RNA
gcttaatctcacacatagaagttttagagctatgct

SEQ ID NO: 333 - RNA, 36 nt, synthetic construct
  misc_feature 1..36: note = Synthetic
  source 1..36: mol_type = other RNA
cttaatctcacacatagaaagttttagagctatgct

SEQ ID NO: 334 - RNA, 36 nt, synthetic construct
  misc_feature 1..36: note = Synthetic
  source 1..36: mol_type = other RNA
ttaatctcacacatagaaaggttttagagctatgct

SEQ ID NO: 335 - RNA, 36 nt, synthetic construct
  misc_feature 1..36: note = Synthetic
  source 1..36: mol_type = other RNA
aggagtgctggtttatcaacgttttagagctatgct

SEQ ID NO: 336 - RNA, 36 nt, synthetic construct
  misc_feature 1..36: note = Synthetic
  source 1..36: mol_type = other RNA
ttctttgacagcaggagtgcgttttagagctatgct

SEQ ID NO: 337 - RNA, 36 nt, synthetic construct
  misc_feature 1..36: note = Synthetic
  source 1..36: mol_type = other RNA
actctggtttctttgacagcgttttagagctatgct

SEQ ID NO: 338 - RNA, 36 nt, synthetic construct
  misc_feature 1..36: note = Synthetic
  source 1..36: mol_type = other RNA
accagagttgagaaaaccccgttttagagctatgct

SEQ ID NO: 339 - RNA, 36 nt, synthetic construct
  misc_feature 1..36: note = Synthetic
  source 1..36: mol_type = other RNA
tccaggggttttctcaactcgttttagagctatgct

SEQ ID NO: 340 - RNA, 36 nt, synthetic construct
  misc_feature 1..36: note = Synthetic
  source 1..36: mol_type = other RNA
cagttattaaatgaatccaggttttagagctatgct

SEQ ID NO: 341 - RNA, 36 nt, synthetic construct
  misc_feature 1..36: note = Synthetic
  source 1..36: mol_type = other RNA
gcagttattaaatgaatccagttttagagctatgct

SEQ ID NO: 342 - RNA, 36 nt, synthetic construct
  misc_feature 1..36: note = Synthetic
  source 1..36: mol_type = other RNA
ggcagttattaaatgaatccgttttagagctatgct

SEQ ID NO: 343 - RNA, 36 nt, synthetic construct
  misc_feature 1..36: note = Synthetic
  source 1..36: mol_type = other RNA
tggatggtaacagctacatcgttttagagctatgct

SEQ ID NO: 344 - RNA, 36 nt, synthetic construct
  misc_feature 1..36: note = Synthetic
  source 1..36: mol_type = other RNA
gctgttaccatccacatcctgttttagagctatgct

SEQ ID NO: 345 - RNA, 36 nt, synthetic construct
  misc_feature 1..36: note = Synthetic
  source 1..36: mol_type = other RNA
tcaagaaccaaggatgtggagttttagagctatgct

SEQ ID NO: 346 - RNA, 36 nt, synthetic construct
  misc_feature 1..36: note = Synthetic
  source 1..36: mol_type = other RNA
tccttcaagaaccaaggatggttttagagctatgct

SEQ ID NO: 347 - RNA, 36 nt, synthetic construct
  misc_feature 1..36: note = Synthetic
  source 1..36: mol_type = other RNA
tgagtgtccttcaagaaccagttttagagctatgct

SEQ ID NO: 348 - RNA, 36 nt, synthetic construct
  misc_feature 1..36: note = Synthetic
  source 1..36: mol_type = other RNA
ttttattttataactacaaggttttagagctatgct

SEQ ID NO: 349 - RNA, 36 nt, synthetic construct
  misc_feature 1..36: note = Synthetic
  source 1..36: mol_type = other RNA
ttgtttttaataaaaacaaggttttagagctatgct

SEQ ID NO: 350 - RNA, 36 nt, synthetic construct
  misc_feature 1..36: note = Synthetic
  source 1..36: mol_type = other RNA
tattatagaatgcttttgcagttttagagctatgct

SEQ ID NO: 351 - RNA, 36 nt, synthetic construct
  misc_feature 1..36: note = Synthetic
  source 1..36: mol_type = other RNA
caagattagtcttgatgtaggttttagagctatgct

SEQ ID NO: 352 - RNA, 36 nt, synthetic construct
  misc_feature 1..36: note = Synthetic
  source 1..36: mol_type = other RNA
aagattagtcttgatgtagtgttttagagctatgct

SEQ ID NO: 353 - RNA, 36 nt, synthetic construct
  misc_feature 1..36: note = Synthetic
  source 1..36: mol_type = other RNA
agtcttgatgtagtgggagtgttttagagctatgct

SEQ ID NO: 354 - RNA, 36 nt, synthetic construct
  misc_feature 1..36: note = Synthetic
  source 1..36: mol_type = other RNA
tttttctattaaaaaaaaaagttttagagctatgct

SEQ ID NO: 355 - RNA, 36 nt, synthetic construct
  misc_feature 1..36: note = Synthetic
  source 1..36: mol_type = other RNA
tctattaaaaaaaaaaaggcgttttagagctatgct

SEQ ID NO: 356 - RNA, 36 nt, synthetic construct
  misc_feature 1..36: note = Synthetic
  source 1..36: mol_type = other RNA
ctattaaaaaaaaaaaggctgttttagagctatgct

SEQ ID NO: 357 - RNA, 36 nt, synthetic construct
  misc_feature 1..36: note = Synthetic
  source 1..36: mol_type = other RNA
aaaaaaaaaaaggctgggcagttttagagctatgct

SEQ ID NO: 358 - RNA, 36 nt, synthetic construct
  misc_feature 1..36: note = Synthetic
  source 1..36: mol_type = other RNA
aaaaaaaaggctgggcacgggttttagagctatgct

SEQ ID NO: 359 - RNA, 36 nt, synthetic construct
  misc_feature 1..36: note = Synthetic
  source 1..36: mol_type = other RNA
cacccgtaatcccagcacttgttttagagctatgct

SEQ ID NO: 360 - RNA, 36 nt, synthetic construct
  misc_feature 1..36: note = Synthetic
  source 1..36: mol_type = other RNA
acccgtaatcccagcactttgttttagagctatgct

SEQ ID NO: 361 - RNA, 36 nt, synthetic construct
  misc_feature 1..36: note = Synthetic
  source 1..36: mol_type = other RNA
cgtaatcccagcactttggggttttagagctatgct

SEQ ID NO: 362 - RNA, 36 nt, synthetic construct
  misc_feature 1..36: note = Synthetic
  source 1..36: mol_type = other RNA
tcccaaagtgctgggattacgttttagagctatgct

SEQ ID NO: 363 - RNA, 36 nt, synthetic construct
  misc_feature 1..36: note = Synthetic
  source 1..36: mol_type = other RNA
ctcccaaagtgctgggattagttttagagctatgct

SEQ ID NO: 364 - RNA, 36 nt, synthetic construct
  misc_feature 1..36: note = Synthetic
  source 1..36: mol_type = other RNA
cccagcactttgggaggccggttttagagctatgct

SEQ ID NO: 365 - RNA, 36 nt, synthetic construct
  misc_feature 1..36: note = Synthetic
  source 1..36: mol_type = other RNA
cctcggcctcccaaagtgctgttttagagctatgct

SEQ ID NO: 366 - RNA, 36 nt, synthetic construct
  misc_feature 1..36: note = Synthetic
  source 1..36: mol_type = other RNA
gcactttgggaggccgaggcgttttagagctatgct

SEQ ID NO: 367 - RNA, 36 nt, synthetic construct
  misc_feature 1..36: note = Synthetic
  source 1..36: mol_type = other RNA
ctttgggaggccgaggcagggttttagagctatgct

SEQ ID NO: 368 - RNA, 36 nt, synthetic construct
  misc_feature 1..36: note = Synthetic
  source 1..36: mol_type = other RNA
gccgaggcaggtggatcacggttttagagctatgct

SEQ ID NO: 369 - RNA, 36 nt, synthetic construct
  misc_feature 1..36: note = Synthetic
  source 1..36: mol_type = other RNA
acctcgtgatccacctgcctgttttagagctatgct

SEQ ID NO: 370 - RNA, 36 nt, synthetic construct
  misc_feature 1..36: note = Synthetic
  source 1..36: mol_type = other RNA
ggcaggtggatcacgaggtcgttttagagctatgct

SEQ ID NO: 371 - RNA, 36 nt, synthetic construct
  misc_feature 1..36: note = Synthetic
  source 1..36: mol_type = other RNA
tcaggagatcgagaccatctgttttagagctatgct

SEQ ID NO: 372 - RNA, 36 nt, synthetic construct
  misc_feature 1..36: note = Synthetic
  source 1..36: mol_type = other RNA
cgagaccatcttggctaacagttttagagctatgct

SEQ ID NO: 373 - RNA, 36 nt, synthetic construct
  misc_feature 1..36: note = Synthetic
  source 1..36: mol_type = other RNA
tttcaccatgttagccaagagttttagagctatgct

SEQ ID NO: 374 - RNA, 36 nt, synthetic construct
  misc_feature 1..36: note = Synthetic
  source 1..36: mol_type = other RNA
ttgtattttttgtagagacggttttagagctatgct

SEQ ID NO: 375 - RNA, 36 nt, synthetic construct
  misc_feature 1..36: note = Synthetic
  source 1..36: mol_type = other RNA
tttgtattttttgtagagacgttttagagctatgct

SEQ ID NO: 376 - RNA, 36 nt, synthetic construct
  misc_feature 1..36: note = Synthetic
  source 1..36: mol_type = other RNA
ttttgtattttttgtagagagttttagagctatgct

SEQ ID NO: 377 - RNA, 36 nt, synthetic construct
  misc_feature 1..36: note = Synthetic
  source 1..36: mol_type = other RNA
aaaaaatacaaaaaattagcgttttagagctatgct

SEQ ID NO: 378 - RNA, 36 nt, synthetic construct
  misc_feature 1..36: note = Synthetic
  source 1..36: mol_type = other RNA
aaaaatacaaaaaattagccgttttagagctatgct

SEQ ID NO: 379 - RNA, 36 nt, synthetic construct
  misc_feature 1..36: note = Synthetic
  source 1..36: mol_type = other RNA
tacaaaaaattagccgggtggttttagagctatgct

SEQ ID NO: 380 - RNA, 36 nt, synthetic construct
  misc_feature 1..36: note = Synthetic
  source 1..36: mol_type = other RNA
aaaaaattagccgggtgtgggttttagagctatgct

SEQ ID NO: 381 - RNA, 36 nt, synthetic construct
  misc_feature 1..36: note = Synthetic
  source 1..36: mol_type = other RNA
aaattagccgggtgtggtgggttttagagctatgct

SEQ ID NO: 382 - RNA, 36 nt, synthetic construct
  misc_feature 1..36: note = Synthetic
  source 1..36: mol_type = other RNA
aattagccgggtgtggtggcgttttagagctatgct

SEQ ID NO: 383 - RNA, 36 nt, synthetic construct
  misc_feature 1..36: note = Synthetic
  source 1..36: mol_type = other RNA
caggcgcccgccaccacaccgttttagagctatgct

SEQ ID NO: 384 - RNA, 36 nt, synthetic construct
  misc_feature 1..36: note = Synthetic
  source 1..36: mol_type = other RNA
gcctgtagtcccagctactcgttttagagctatgct

SEQ ID NO: 385 - RNA, 36 nt, synthetic construct
  misc_feature 1..36: note = Synthetic
  source 1..36: mol_type = other RNA
tgtagtcccagctactcagggttttagagctatgct

SEQ ID NO: 386 - RNA, 36 nt, synthetic construct
  misc_feature 1..36: note = Synthetic
  source 1..36: mol_type = other RNA
tcctgagtagctgggactacgttttagagctatgct

SEQ ID NO: 387 - RNA, 36 nt, synthetic construct
  misc_feature 1..36: note = Synthetic
  source 1..36: mol_type = other RNA
cccagctactcaggaggctggttttagagctatgct

SEQ ID NO: 388 - RNA, 36 nt, synthetic construct
  misc_feature 1..36: note = Synthetic
  source 1..36: mol_type = other RNA
cctcagcctcctgagtagctgttttagagctatgct

SEQ ID NO: 389 - RNA, 36 nt, synthetic construct
  misc_feature 1..36: note = Synthetic
  source 1..36: mol_type = other RNA
gcctcagcctcctgagtagcgttttagagctatgct

SEQ ID NO: 390 - RNA, 36 nt, synthetic construct
  misc_feature 1..36: note = Synthetic
  source 1..36: mol_type = other RNA
aggaggctgaggcaggagaagttttagagctatgct

SEQ ID NO: 391 - RNA, 36 nt, synthetic construct
  misc_feature 1..36: note = Synthetic
  source 1..36: mol_type = other RNA
gcaggagaatggcgtgaaccgttttagagctatgct

SEQ ID NO: 392 - RNA, 36 nt, synthetic construct
  misc_feature 1..36: note = Synthetic
  source 1..36: mol_type = other RNA
caggagaatggcgtgaacccgttttagagctatgct

SEQ ID NO: 393 - RNA, 36 nt, synthetic construct
  misc_feature 1..36: note = Synthetic
  source 1..36: mol_type = other RNA
gagaatggcgtgaacccggggttttagagctatgct

SEQ ID NO: 394 - RNA, 36 nt, synthetic construct
  misc_feature 1..36: note = Synthetic
  source 1..36: mol_type = other RNA
aatggcgtgaacccgggagggttttagagctatgct

SEQ ID NO: 395 - RNA, 36 nt, synthetic construct
  misc_feature 1..36: note = Synthetic
  source 1..36: mol_type = other RNA
cactgcaagctccacctcccgttttagagctatgct

SEQ ID NO: 396 - RNA, 36 nt, synthetic construct
  misc_feature 1..36: note = Synthetic
  source 1..36: mol_type = other RNA
tcactgcaagctccacctccgttttagagctatgct

SEQ ID NO: 397 - RNA, 36 nt, synthetic construct
  misc_feature 1..36: note = Synthetic
  source 1..36: mol_type = other RNA
cataccactgcactccagccgttttagagctatgct

SEQ ID NO: 398 - RNA, 36 nt, synthetic construct
  misc_feature 1..36: note = Synthetic
  source 1..36: mol_type = other RNA
ataccactgcactccagcctgttttagagctatgct

SEQ ID NO: 399 - RNA, 36 nt, synthetic construct
  misc_feature 1..36: note = Synthetic
  source 1..36: mol_type = other RNA
tcgcccaggctggagtgcaggttttagagctatgct

SEQ ID NO: 400 - RNA, 36 nt, synthetic construct
  misc_feature 1..36: note = Synthetic
  source 1..36: mol_type = other RNA
tctcactctttcgcccaggcgttttagagctatgct

SEQ ID NO: 401 - RNA, 36 nt, synthetic construct
  misc_feature 1..36: note = Synthetic
  source 1..36: mol_type = other RNA
ggagtctcactctttcgcccgttttagagctatgct

SEQ ID NO: 402 - RNA, 36 nt, synthetic construct
  misc_feature 1..36: note = Synthetic
  source 1..36: mol_type = other RNA
tgttttttgtttttttgagagttttagagctatgct

SEQ ID NO: 403 - RNA, 36 nt, synthetic construct
  misc_feature 1..36: note = Synthetic
  source 1..36: mol_type = other RNA
aggaagaaagaaaggtttttgttttagagctatgct

SEQ ID NO: 404 - RNA, 36 nt, synthetic construct
  misc_feature 1..36: note = Synthetic
  source 1..36: mol_type = other RNA
agaagaaaaggaagaaagaagttttagagctatgct

SEQ ID NO: 405 - RNA, 36 nt, synthetic construct
  misc_feature 1..36: note = Synthetic
  source 1..36: mol_type = other RNA
ctttcttccttttcttctctgttttagagctatgct

SEQ ID NO: 406 - RNA, 36 nt, synthetic construct
  misc_feature 1..36: note = Synthetic
  source 1..36: mol_type = other RNA
tttcttccttttcttctcttgttttagagctatgct

SEQ ID NO: 407 - RNA, 36 nt, synthetic construct
  misc_feature 1..36: note = Synthetic
  source 1..36: mol_type = other RNA
aatggacccaagagaagaaagttttagagctatgct

SEQ ID NO: 408 - RNA, 36 nt, synthetic construct
  misc_feature 1..36: note = Synthetic
  source 1..36: mol_type = other RNA
ggctattacataagaaacaagttttagagctatgct

SEQ ID NO: 409 - RNA, 36 nt, synthetic construct
  misc_feature 1..36: note = Synthetic
  source 1..36: mol_type = other RNA
cacaggaaaaggaactgtacgttttagagctatgct

SEQ ID NO: 410 - RNA, 36 nt, synthetic construct
  misc_feature 1..36: note = Synthetic
  source 1..36: mol_type = other RNA
attaaagctaacacaggaaagttttagagctatgct

SEQ ID NO: 411 - RNA, 36 nt, synthetic construct
  misc_feature 1..36: note = Synthetic
  source 1..36: mol_type = other RNA
tcaaaaattaaagctaacacgttttagagctatgct

SEQ ID NO: 412 - RNA, 36 nt, synthetic construct
  misc_feature 1..36: note = Synthetic
  source 1..36: mol_type = other RNA
taaaattgtctaaacatctcgttttagagctatgct

SEQ ID NO: 413 - RNA, 36 nt, synthetic construct
  misc_feature 1..36: note = Synthetic
  source 1..36: mol_type = other RNA
agagatgtttagacaattttgttttagagctatgct

SEQ ID NO: 414 - RNA, 36 nt, synthetic construct
  misc_feature 1..36: note = Synthetic
  source 1..36: mol_type = other RNA
tctaaacatctctgggaccagttttagagctatgct

SEQ ID NO: 415 - RNA, 36 nt, synthetic construct
  misc_feature 1..36: note = Synthetic
  source 1..36: mol_type = other RNA
tttatgctttcatatatcctgttttagagctatgct

SEQ ID NO: 416 - RNA, 36 nt, synthetic construct
  misc_feature 1..36: note = Synthetic
  source 1..36: mol_type = other RNA
agcataaattacaaagaaaagttttagagctatgct

SEQ ID NO: 417 - RNA, 36 nt, synthetic construct
  misc_feature 1..36: note = Synthetic
  source 1..36: mol_type = other RNA
tacaaagaaaaaggttatcagttttagagctatgct

SEQ ID NO: 418 - RNA, 36 nt, synthetic construct
  misc_feature 1..36: note = Synthetic
  source 1..36: mol_type = other RNA
acaaagaaaaaggttatcatgttttagagctatgct

SEQ ID NO: 419 - RNA, 36 nt, synthetic construct
  misc_feature 1..36: note = Synthetic
  source 1..36: mol_type = other RNA
caaagaaaaaggttatcatggttttagagctatgct

SEQ ID NO: 420 - RNA, 36 nt, synthetic construct
  misc_feature 1..36: note = Synthetic
  source 1..36: mol_type = other RNA
tctgagatttaaaatagagtgttttagagctatgct

SEQ ID NO: 421 - RNA, 36 nt, synthetic construct
  misc_feature 1..36: note = Synthetic
  source 1..36: mol_type = other RNA
cttataagatacattatgaagttttagagctatgct

SEQ ID NO: 422 - RNA, 36 nt, synthetic construct
  misc_feature 1..36: note = Synthetic
  source 1..36: mol_type = other RNA
tatcttataagactataaaagttttagagctatgct

SEQ ID NO: 423 - RNA, 36 nt, synthetic construct
  misc_feature 1..36: note = Synthetic
  source 1..36: mol_type = other RNA
atcttataagactataaaaagttttagagctatgct

SEQ ID NO: 424 - RNA, 36 nt, synthetic construct
  misc_feature 1..36: note = Synthetic
  source 1..36: mol_type = other RNA
ttataagactataaaaaggggttttagagctatgct

SEQ ID NO: 425 - RNA, 36 nt, synthetic construct
  misc_feature 1..36: note = Synthetic
  source 1..36: mol_type = other RNA
taaaaagggaggaaatataggttttagagctatgct

SEQ ID NO: 426 - RNA, 36 nt, synthetic construct
  misc_feature 1..36: note = Synthetic
  source 1..36: mol_type = other RNA
aaaaagggaggaaatatagagttttagagctatgct

SEQ ID NO: 427 - RNA, 36 nt, synthetic construct
  misc_feature 1..36: note = Synthetic
  source 1..36: mol_type = other RNA
aaatatagagggtccactttgttttagagctatgct

SEQ ID NO: 428 - RNA, 36 nt, synthetic construct
  misc_feature 1..36: note = Synthetic
  source 1..36: mol_type = other RNA
tatagagggtccacttttgggttttagagctatgct

SEQ ID NO: 429 - RNA, 36 nt, synthetic construct
  misc_feature 1..36: note = Synthetic
  source 1..36: mol_type = other RNA
actctgaagtccaccaaaaggttttagagctatgct

SEQ ID NO: 430 - RNA, 36 nt, synthetic construct
  misc_feature 1..36: note = Synthetic
  source 1..36: mol_type = other RNA
agaatagagttgcaccgtttgttttagagctatgct

SEQ ID NO: 431 - RNA, 36 nt, synthetic construct
  misc_feature 1..36: note = Synthetic
  source 1..36: mol_type = other RNA
aaaacggtgcaactctattcgttttagagctatgct

SEQ ID NO: 432 - RNA, 36 nt, synthetic construct
  misc_feature 1..36: note = Synthetic
  source 1..36: mol_type = other RNA
ccgttttgggctaatgaaaagttttagagctatgct

SEQ ID NO: 433 - RNA, 36 nt, synthetic construct
  misc_feature 1..36: note = Synthetic
  source 1..36: mol_type = other RNA
cctttttcattagcccaaaagttttagagctatgct

SEQ ID NO: 434 - RNA, 36 nt, synthetic construct
  misc_feature 1..36: note = Synthetic
  source 1..36: mol_type = other RNA
tgggctaatgaaaaaggaaggttttagagctatgct

SEQ ID NO: 435 - RNA, 36 nt, synthetic construct
  misc_feature 1..36: note = Synthetic
  source 1..36: mol_type = other RNA
taatgaaaaaggaagaggctgttttagagctatgct

SEQ ID NO: 436 - RNA, 36 nt, synthetic construct
  misc_feature 1..36: note = Synthetic
  source 1..36: mol_type = other RNA
aatgaaaaaggaagaggctagttttagagctatgct

SEQ ID NO: 437 - RNA, 36 nt, synthetic construct
  misc_feature 1..36: note = Synthetic
  source 1..36: mol_type = other RNA
ctgaatcttaaaatatgtccgttttagagctatgct

SEQ ID NO: 438 - RNA, 36 nt, synthetic construct
  misc_feature 1..36: note = Synthetic
  source 1..36: mol_type = other RNA
caggcagctttatctcaaccgttttagagctatgct

SEQ ID NO: 439 - RNA, 36 nt, synthetic construct
  misc_feature 1..36: note = Synthetic
  source 1..36: mol_type = other RNA
ctaagagatcaagtttcagcgttttagagctatgct

SEQ ID NO: 440 - RNA, 36 nt, synthetic construct
  misc_feature 1..36: note = Synthetic
  source 1..36: mol_type = other RNA
gtgttcttgttgatattctggttttagagctatgct

SEQ ID NO: 441 - RNA, 36 nt, synthetic construct
  misc_feature 1..36: note = Synthetic
  source 1..36: mol_type = other RNA
cttgttgatattctgtggcagttttagagctatgct

SEQ ID NO: 442 - RNA, 36 nt, synthetic construct
  misc_feature 1..36: note = Synthetic
  source 1..36: mol_type = other RNA
tctgtggcatggctacagatgttttagagctatgct

SEQ ID NO: 443 - RNA, 36 nt, synthetic construct
  misc_feature 1..36: note = Synthetic
  source 1..36: mol_type = other RNA
agaacttatttacacagggagttttagagctatgct

SEQ ID NO: 444 - RNA, 36 nt, synthetic construct
  misc_feature 1..36: note = Synthetic
  source 1..36: mol_type = other RNA
aaagagaacttatttacacagttttagagctatgct

SEQ ID NO: 445 - RNA, 36 nt, synthetic construct
  misc_feature 1..36: note = Synthetic
  source 1..36: mol_type = other RNA
caaagagaacttatttacacgttttagagctatgct

SEQ ID NO: 446 - RNA, 36 nt, synthetic construct
  misc_feature 1..36: note = Synthetic
  source 1..36: mol_type = other RNA
ttctctttgtatttacttttgttttagagctatgct

SEQ ID NO: 447 - RNA, 36 nt, synthetic construct
  misc_feature 1..36: note = Synthetic
  source 1..36: mol_type = other RNA
tctctttgtatttacttttagttttagagctatgct

SEQ ID NO: 448 - RNA, 36 nt, synthetic construct
  misc_feature 1..36: note = Synthetic
  source 1..36: mol_type = other RNA
ctttgtatttacttttaggggttttagagctatgct

SEQ ID NO: 449 - RNA, 36 nt, synthetic construct
  misc_feature 1..36: note = Synthetic
  source 1..36: mol_type = other RNA
agcttttgtccacctttaaagttttagagctatgct

SEQ ID NO: 450 - RNA, 36 nt, synthetic construct
  misc_feature 1..36: note = Synthetic
  source 1..36: mol_type = other RNA
tttatttttccatttaaagggttttagagctatgct

SEQ ID NO: 451 - RNA, 36 nt, synthetic construct
  misc_feature 1..36: note = Synthetic
  source 1..36: mol_type = other RNA
tattttatttttccatttaagttttagagctatgct

SEQ ID NO: 452 - RNA, 36 nt, synthetic construct
  misc_feature 1..36: note = Synthetic
  source 1..36: mol_type = other RNA
cttacataaacatacttaaagttttagagctatgct

SEQ ID NO: 453 - RNA, 36 nt, synthetic construct
  misc_feature 1..36: note = Synthetic
  source 1..36: mol_type = other RNA
taagcacagaagtttttaaggttttagagctatgct

SEQ ID NO: 454 - RNA, 36 nt, synthetic construct
  misc_feature 1..36: note = Synthetic
  source 1..36: mol_type = other RNA
aagtttttaagaggcatgaagttttagagctatgct

SEQ ID NO: 455 - RNA, 36 nt, synthetic construct
  misc_feature 1..36: note = Synthetic
  source 1..36: mol_type = other RNA
atatttacgtagtttttcatgttttagagctatgct

SEQ ID NO: 456 - RNA, 36 nt, synthetic construct
  misc_feature 1..36: note = Synthetic
  source 1..36: mol_type = other RNA
cgtaaatattcttgagaaacgttttagagctatgct

SEQ ID NO: 457 - RNA, 36 nt, synthetic construct
  misc_feature 1..36: note = Synthetic
  source 1..36: mol_type = other RNA
ttcttgagaaacaggaagacgttttagagctatgct

SEQ ID NO: 458 - RNA, 36 nt, synthetic construct
  misc_feature 1..36: note = Synthetic
  source 1..36: mol_type = other RNA
taatattaaaaacattggttgttttagagctatgct

SEQ ID NO: 459 - RNA, 36 nt, synthetic construct
  misc_feature 1..36: note = Synthetic
  source 1..36: mol_type = other RNA
ccaatgtttttaatattatcgttttagagctatgct

SEQ ID NO: 460 - RNA, 36 nt, synthetic construct
  misc_feature 1..36: note = Synthetic
  source 1..36: mol_type = other RNA
cctgataatattaaaaacatgttttagagctatgct

SEQ ID NO: 461 - RNA, 36 nt, synthetic construct
  misc_feature 1..36: note = Synthetic
  source 1..36: mol_type = other RNA
cattatcatgcatacatctcgttttagagctatgct

SEQ ID NO: 462 - RNA, 36 nt, synthetic construct
  misc_feature 1..36: note = Synthetic
  source 1..36: mol_type = other RNA
atcatgcatacatctctggcgttttagagctatgct

SEQ ID NO: 463 - RNA, 36 nt, synthetic construct
  misc_feature 1..36: note = Synthetic
  source 1..36: mol_type = other RNA
ttcatttcattttgattttggttttagagctatgct

SEQ ID NO: 464 - RNA, 36 nt, synthetic construct
  misc_feature 1..36: note = Synthetic
  source 1..36: mol_type = other RNA
attcaatttgaagcagtggtgttttagagctatgct

SEQ ID NO: 465 - RNA, 36 nt, synthetic construct
  misc_feature 1..36: note = Synthetic
  source 1..36: mol_type = other RNA
gaatattcaatttgaagcaggttttagagctatgct

SEQ ID NO: 466 - RNA, 36 nt, synthetic construct
  misc_feature 1..36: note = Synthetic
  source 1..36: mol_type = other RNA
catacgatttaaaatcgctggttttagagctatgct

SEQ ID NO: 467 - RNA, 36 nt, synthetic construct
  misc_feature 1..36: note = Synthetic
  source 1..36: mol_type = other RNA
aaaatcgctgaggcgcgttcgttttagagctatgct

SEQ ID NO: 468 - RNA, 36 nt, synthetic construct
  misc_feature 1..36: note = Synthetic
  source 1..36: mol_type = other RNA
tttttttttcttttttgtacgttttagagctatgct

SEQ ID NO: 469 - RNA, 36 nt, synthetic construct
  misc_feature 1..36: note = Synthetic
  source 1..36: mol_type = other RNA
ctgttgtcaaagattttaaagttttagagctatgct

SEQ ID NO: 470 - RNA, 36 nt, synthetic construct
  misc_feature 1..36: note = Synthetic
  source 1..36: mol_type = other RNA
tgacaacagagttctgttttgttttagagctatgct

SEQ ID NO: 471 - RNA, 36 nt, synthetic construct
  misc_feature 1..36: note = Synthetic
  source 1..36: mol_type = other RNA
agaatacgctgagagttatcgttttagagctatgct

SEQ ID NO: 472 - RNA, 36 nt, synthetic construct
  misc_feature 1..36: note = Synthetic
  source 1..36: mol_type = other RNA
gcaagagaagaaaagaacgggttttagagctatgct

SEQ ID NO: 473 - RNA, 36 nt, synthetic construct
  misc_feature 1..36: note = Synthetic
  source 1..36: mol_type = other RNA
gttgcaagagaagaaaagaagttttagagctatgct

SEQ ID NO: 474 - RNA, 36 nt, synthetic construct
  misc_feature 1..36: note = Synthetic
  source 1..36: mol_type = other RNA
atgcacacgtaaaagagagggttttagagctatgct

SEQ ID NO: 475 - RNA, 36 nt, synthetic construct
  misc_feature 1..36: note = Synthetic
  source 1..36: mol_type = other RNA
aagatgcacacgtaaaagaggttttagagctatgct

SEQ ID NO: 476 - RNA, 36 nt, synthetic construct; identical to SEQ ID NO: 462
  misc_feature 1..36: note = Synthetic
  source 1..36: mol_type = other RNA

SEQ ID NO: 477 - RNA, 36 nt, synthetic construct; identical to SEQ ID NO: 463
  misc_feature 1..36: note = Synthetic
  source 1..36: mol_type = other RNA

SEQ ID NO: 478 - RNA, 36 nt, synthetic construct; identical to SEQ ID NO: 464
  misc_feature 1..36: note = Synthetic
  source 1..36: mol_type = other RNA

SEQ ID NO: 479 - RNA, 36 nt, synthetic construct; identical to SEQ ID NO: 465
  misc_feature 1..36: note = Synthetic
  source 1..36: mol_type = other RNA

SEQ ID NO: 480 - RNA, 36 nt, synthetic construct; identical to SEQ ID NO: 466
  misc_feature 1..36: note = Synthetic
  source 1..36: mol_type = other RNA

SEQ ID NO: 481 - RNA, 36 nt, synthetic construct; identical to SEQ ID NO: 467
  misc_feature 1..36: note = Synthetic
  source 1..36: mol_type = other RNA

SEQ ID NO: 482 - RNA, 36 nt, synthetic construct; identical to SEQ ID NO: 468
  misc_feature 1..36: note = Synthetic
  source 1..36: mol_type = other RNA

SEQ ID NO: 483 - RNA, 36 nt, synthetic construct; identical to SEQ ID NO: 469
  misc_feature 1..36: note = Synthetic
  source 1..36: mol_type = other RNA

SEQ ID NO: 484 - RNA, 36 nt, synthetic construct; identical to SEQ ID NO: 470
  misc_feature 1..36: note = Synthetic
  source 1..36: mol_type = other RNA

SEQ ID NO: 485 - RNA, 36 nt, synthetic construct; identical to SEQ ID NO: 471
  misc_feature 1..36: note = Synthetic
  source 1..36: mol_type = other RNA

SEQ ID NO: 486 - RNA, 36 nt, synthetic construct; identical to SEQ ID NO: 472
  misc_feature 1..36: note = Synthetic
  source 1..36: mol_type = other RNA

SEQ ID NO: 487 - RNA, 36 nt, synthetic construct; identical to SEQ ID NO: 473
  misc_feature 1..36: note = Synthetic
  source 1..36: mol_type = other RNA

SEQ ID NO: 488 - RNA, 36 nt, synthetic construct; identical to SEQ ID NO: 474
  misc_feature 1..36: note = Synthetic
  source 1..36: mol_type = other RNA

SEQ ID NO: 489 - RNA, 36 nt, synthetic construct; identical to SEQ ID NO: 475
  misc_feature 1..36: note = Synthetic
  source 1..36: mol_type = other RNA

SEQ ID NO: 490 - RNA, 36 nt, synthetic construct
  misc_feature 1..36: note = Synthetic
  source 1..36: mol_type = other RNA
ggcagaccgttctcatcacggttttagagctatgct

SEQ ID NO: 491 - RNA, 36 nt, synthetic construct
  misc_feature 1..36: note = Synthetic
  source 1..36: mol_type = other RNA
ctttaccagtgactccaggtgttttagagctatgct

SEQ ID NO: 492 - RNA, 36 nt, synthetic construct
  misc_feature 1..36: note = Synthetic
  source 1..36: mol_type = other RNA
gtcacagatttccttctccggttttagagctatgct

SEQ ID NO: 493 - RNA, 36 nt, synthetic construct
  misc_feature 1..36: note = Synthetic
  source 1..36: mol_type = other RNA
agatgatgacgcccaccagagttttagagctatgct

SEQ ID NO: 494 - RNA, 36 nt, synthetic construct
  misc_feature 1..36: note = Synthetic
  source 1..36: mol_type = other RNA
ggagaaggaaatctgtgaccgttttagagctatgct

SEQ ID NO: 495 - RNA, 36 nt, synthetic construct
  misc_feature 1..36: note = Synthetic
  source 1..36: mol_type = other RNA
tgcgaggaacttacttttccgttttagagctatgct

SEQ ID NO: 496 - RNA, 36 nt, synthetic construct
  misc_feature 1..36: note = Synthetic
  source 1..36: mol_type = other RNA
agagaaatattgatataggagttttagagctatgct

SEQ ID NO: 497 - RNA, 36 nt, synthetic construct
  misc_feature 1..36: note = Synthetic
  source 1..36: mol_type = other RNA
tatcaatatttctctgatccgttttagagctatgct

SEQ ID NO: 498 - RNA, 36 nt, synthetic construct
  misc_feature 1..36: note = Synthetic
  source 1..36: mol_type = other RNA
atcgcttttaaggcacgctcgttttagagctatgct

SEQ ID NO: 499 - RNA, 36 nt, synthetic construct
  misc_feature 1..36: note = Synthetic
  source 1..36: mol_type = other RNA
tatacgactgatcgcttttagttttagagctatgct

SEQ ID NO: 500 - RNA, 97 nt, synthetic construct
  misc_feature 1..97: note = Synthetic
  source 1..97: mol_type = other RNA
tgtcaggttagttagatgaagttttagagctagaaatagcaagttaaaataaggctagtccgttatcaacttgaaaaagtggcaccgagtcggtgct

SEQ ID NO: 501 - RNA, 97 nt, synthetic construct
  misc_feature 1..97: note = Synthetic
  source 1..97: mol_type = other RNA
gtgtcaggttagttagatgagttttagagctagaaatagcaagttaaaataaggctagtccgttatcaacttgaaaaagtggcaccgagtcggtgct

SEQ ID NO: 502 - RNA, 97 nt, synthetic construct
  misc_feature 1..97: note = Synthetic
  source 1..97: mol_type = other RNA
cctgacacatatacagactagttttagagctagaaatagcaagttaaaataaggctagtccgttatcaacttgaaaaagtggcaccgagtcggtgct

SEQ ID NO: 503 - RNA, 97 nt, synthetic construct
  misc_feature 1..97: note = Synthetic
  source 1..97: mol_type = other RNA
ctgacacatatacagactaagttttagagctagaaatagcaagttaaaataaggctagtccgttatcaacttgaaaaagtggcaccgagtcggtgct

SEQ ID NO: 504 - RNA, 97 nt, synthetic construct
  misc_feature 1..97: note = Synthetic
  source 1..97: mol_type = other RNA
ccttagtctgtatatgtgtcgttttagagctagaaatagcaagttaaaataaggctagtccgttatcaacttgaaaaagtggcaccgagtcggtgct

SEQ ID NO: 505 - RNA, 97 nt, synthetic construct
  misc_feature 1..97: note = Synthetic
  source 1..97: mol_type = other RNA
catatacagactaagggaccgttttagagctagaaatagcaagttaaaataaggctagtccgttatcaacttgaaaaagtggcaccgagtcggtgct

SEQ ID NO: 506 - RNA, 97 nt, synthetic construct
  misc_feature 1..97: note = Synthetic
  source 1..97: mol_type = other RNA
atatacagactaagggaccagttttagagctagaaatagcaagttaaaataaggctagtccgttatcaacttgaaaaagtggcaccgagtcggtgct

SEQ ID NO: 507 - RNA, 97 nt, synthetic construct
  misc_feature 1..97: note = Synthetic
  source 1..97: mol_type = other RNA
tcaaagtttgataaattcccgttttagagctagaaatagcaagttaaaataaggctagtccgttatcaacttgaaaaagtggcaccgagtcggtgct

SEQ ID NO: 508 - RNA, 97 nt, synthetic construct
  misc_feature 1..97: note = Synthetic
  source 1..97: mol_type = other RNA
aaaatacaaagataagtagagttttagagctagaaatagcaagttaaaataaggctagtccgttatcaacttgaaaaagtggcaccgagtcggtgct

SEQ ID NO: 509 - RNA, 97 nt, synthetic construct
  misc_feature 1..97: note = Synthetic
  source 1..97: mol_type = other RNA
actctgtgactttaaaaagtgttttagagctagaaatagcaagttaaaataaggctagtccgttatcaacttgaaaaagtggcaccgagtcggtgct

SEQ ID NO: 510 - RNA, 97 nt, synthetic construct
  misc_feature 1..97: note = Synthetic
  source 1..97: mol_type = other RNA
ggttctgtgggatattaatagttttagagctagaaatagcaagttaaaataaggctagtccgttatcaacttgaaaaagtggcaccgagtcggtgct

SEQ ID NO: 511 - RNA, 97 nt, synthetic construct
  misc_feature 1..97: note = Synthetic
  source 1..97: mol_type = other RNA
acagagcatattggttctgtgttttagagctagaaatagcaagttaaaataaggctagtccgttatcaacttgaaaaagtggcaccgagtcggtgct

SEQ ID NO: 512 - RNA, 97 nt, synthetic construct
  misc_feature 1..97: note = Synthetic
  source 1..97: mol_type = other RNA
gacagagcatattggttctggttttagagctagaaatagcaagttaaaataaggctagtccgttatcaacttgaaaaagtggcaccgagtcggtgct

SEQ ID NO: 513 - RNA, 97 nt, synthetic construct
  misc_feature 1..97: note = Synthetic
  source 1..97: mol_type = other RNA
tgcaaaacgacagagcatatgttttagagctagaaatagcaagttaaaataaggctagtccgttatcaacttgaaaaagtggcaccgagtcggtgct

SEQ ID NO: 514 - RNA, 97 nt, synthetic construct
  misc_feature 1..97: note = Synthetic
  source 1..97: mol_type = other RNA
gagctgggcatggaataggcgttttagagctagaaatagcaagttaaaataaggctagtccgttatcaacttgaaaaagtggcaccgagtcggtgct

SEQ ID NO: 515 - RNA, 97 nt, synthetic construct
  misc_feature 1..97: note = Synthetic
  source 1..97: mol_type = other RNA
actggagctgggcatggaatgttttagagctagaaatagcaagttaaaataaggctagtccgttatcaacttgaaaaagtggcaccgagtcggtgct

SEQ ID NO: 516 - RNA, 97 nt, synthetic construct
  misc_feature 1..97: note = Synthetic
  source 1..97: mol_type = other RNA
ctcattactggagctgggcagttttagagctagaaatagcaagttaaaataaggctagtccgttatcaacttgaaaaagtggcaccgagtcggtgct

SEQ ID NO: 517 - RNA, 97 nt, synthetic construct
  misc_feature 1..97: note = Synthetic
  source 1..97: mol_type = other RNA
ttgttctcattactggagctgttttagagctagaaatagcaagttaaaataaggctagtccgttatcaacttgaaaaagtggcaccgagtcggtgct

SEQ ID NO: 518 - RNA, 97 nt, synthetic construct
  misc_feature 1..97: note = Synthetic
  source 1..97: mol_type = other RNA
attgttctcattactggagcgttttagagctagaaatagcaagttaaaataaggctagtccgttatcaacttgaaaaagtggcaccgagtcggtgct

SEQ ID NO: 519 - RNA, 97 nt, synthetic construct
  misc_feature 1..97: note = Synthetic
  source 1..97: mol_type = other RNA
ggggagattgttctcattacgttttagagctagaaatagcaagttaaaataaggctagtccgttatcaacttgaaaaagtggcaccgagtcggtgct

SEQ ID NO: 520 - RNA, 97 nt, synthetic construct
  misc_feature 1..97: note = Synthetic
  source 1..97: mol_type = other RNA
gaggagaaaatctgtggctggttttagagctagaaatagcaagttaaaataaggctagtccgttatcaacttgaaaaagtggcaccgagtcggtgct

SEQ ID NO: 521 - RNA, 97 nt, synthetic construct
  misc_feature 1..97: note = Synthetic
  source 1..97: mol_type = other RNA
agaggagaaaatctgtggctgttttagagctagaaatagcaagttaaaataaggctagtccgttatcaacttgaaaaagtggcaccgagtcggtgct

SEQ ID NO: 522 - RNA, 97 nt, synthetic construct
  misc_feature 1..97: note = Synthetic
  source 1..97: mol_type = other RNA
cagaggagaaaatctgtggcgttttagagctagaaatagcaagttaaaataaggctagtccgttatcaacttgaaaaagtggcaccgagtcggtgct

SEQ ID NO: 523 - RNA, 97 nt, synthetic construct
  misc_feature 1..97: note = Synthetic
  source 1..97: mol_type = other RNA
tcctcagaggagaaaatctggttttagagctagaaatagcaagttaaaataaggctagtccgttatcaacttgaaaaagtggcaccgagtcggtgct

SEQ ID NO: 524 - RNA, 97 nt, synthetic construct
  misc_feature 1..97: note = Synthetic
  source 1..97: mol_type = other RNA
tgaagtttttcattcctcaggttttagagctagaaatagcaagttaaaataaggctagtccgttatcaacttgaaaaagtggcaccgagtcggtgct

SEQ ID NO: 525 - RNA, 97 nt, synthetic construct
  misc_feature 1..97: note = Synthetic
  source 1..97: mol_type = other RNA
cttcaccaacgactccaagtgttttagagctagaaatagcaagttaaaataaggctagtccgttatcaacttgaaaaagtggcaccgagtcggtgct

SEQ ID NO: 526 - RNA, 97 nt, synthetic construct
  misc_feature 1..97: note = Synthetic
  source 1..97: mol_type = other RNA
ctactcctacttggagtcgtgttttagagctagaaatagcaagttaaaataaggctagtccgttatcaacttgaaaaagtggcaccgagtcggtgct

SEQ ID NO: 527 - RNA, 97 nt, synthetic construct
  misc_feature 1..97: note = Synthetic
  source 1..97: mol_type = other RNA
ctccaagtaggagtagatgagttttagagctagaaatagcaagttaaaataaggctagtccgttatcaacttgaaaaagtggcaccgagtcggtgct

SEQ ID NO: 528 - RNA, 97 nt, synthetic construct
  misc_feature 1..97: note = Synthetic
  source 1..97: mol_type = other RNA
caccatcatctactcctactgttttagagctagaaatagcaagttaaaataaggctagtccgttatcaacttgaaaaagtggcaccgagtcggtgct

SEQ ID NO: 529 - RNA, 97 nt, synthetic construct
  misc_feature 1..97: note = Synthetic
  source 1..97: mol_type = other RNA
tgatggtgatcagaagcagagttttagagctagaaatagcaagttaaaataaggctagtccgttatcaacttgaaaaagtggcaccgagtcggtgct

SEQ ID NO: 530 - RNA, 97 nt, synthetic construct
  misc_feature 1..97: note = Synthetic
  source 1..97: mol_type = other RNA
tcagaagcagaaggatttctgttttagagctagaaatagcaagttaaaataaggctagtccgttatcaacttgaaaaagtggcaccgagtcggtgct

SEQ ID NO: 531 - RNA, 97 nt, synthetic construct
  misc_feature 1..97: note = Synthetic
  source 1..97: mol_type = other RNA
gatttctaggatgatgttcagttttagagctagaaatagcaagttaaaataaggctagtccgttatcaacttgaaaaagtggcaccgagtcggtgct

SEQ ID NO: 532 - RNA, 97 nt, synthetic construct
  misc_feature 1..97: note = Synthetic
  source 1..97: mol_type = other RNA
ttgctctgtcctcttccttcgttttagagctagaaatagcaagttaaaataaggctagtccgttatcaacttgaaaaagtggcaccgagtcggtgct

SEQ ID NO: 533 - RNA, 97 nt, synthetic construct
  misc_feature 1..97: note = Synthetic
  source 1..97: mol_type = other RNA
aggactgaaccagaaggaaggttttagagctagaaatagcaagttaaaataaggctagtccgttatcaacttgaaaaagtggcaccgagtcggtgct

SEQ ID NO: 534 - RNA, 97 nt, synthetic construct
  misc_feature 1..97: note = Synthetic
  source 1..97: mol_type = other RNA
tacacaaggactgaaccagagttttagagctagaaatagcaagttaaaataaggctagtccgttatcaacttgaaaaagtggcaccgagtcggtgct

SEQ ID NO: 535 - RNA, 97 nt, synthetic construct
  misc_feature 1..97: note = Synthetic
  source 1..97: mol_type = other RNA
ttcagtccttgtgtagtcctgttttagagctagaaatagcaagttaaaataaggctagtccgttatcaacttgaaaaagtggcaccgagtcggtgct

SEQ ID NO: 536 - RNA, 97 nt, synthetic construct
  misc_feature 1..97: note = Synthetic
  source 1..97: mol_type = other RNA
tcagtccttgtgtagtcctagttttagagctagaaatagcaagttaaaataaggctagtccgttatcaacttgaaaaagtggcaccgagtcggtgct

SEQ ID NO: 537 - RNA, 97 nt, synthetic construct
  misc_feature 1..97: note = Synthetic
  source 1..97: mol_type = other RNA
gtccttgtgtagtcctaggggttttagagctagaaatagcaagttaaaataaggctagtccgttatcaacttgaaaaagtggcaccgagtcggtgct

SEQ ID NO: 538 - RNA, 97 nt, synthetic construct
  misc_feature 1..97: note = Synthetic
  source 1..97: mol_type = other RNA
cttgtgtagtcctagggagggttttagagctagaaatagcaagttaaaataaggctagtccgttatcaacttgaaaaagtggcaccgagtcggtgct

SEQ ID NO: 539 - RNA, 97 nt, synthetic construct
  misc_feature 1..97: note = Synthetic
  source 1..97: mol_type = other RNA
ctcctccctaggactacacagttttagagctagaaatagcaagttaaaataaggctagtccgttatcaacttgaaaaagtggcaccgagtcggtgct

SEQ ID NO: 540 - RNA, 97 nt, synthetic construct
  misc_feature 1..97: note = Synthetic
  source 1..97: mol_type = other RNA
gtagacagtacctcctccctgttttagagctagaaatagcaagttaaaataaggctagtccgttatcaacttgaaaaagtggcaccgagtcggtgct

SEQ ID NO: 541 - RNA, 97 nt, synthetic construct
  misc_feature 1..97: note = Synthetic
  source 1..97: mol_type = other RNA
tactgtctacacagagctctgttttagagctagaaatagcaagttaaaataaggctagtccgttatcaacttgaaaaagtggcaccgagtcggtgct

SEQ ID NO: 542 - RNA, 97 nt, synthetic construct
  misc_feature 1..97: note = Synthetic
  source 1..97: mol_type = other RNA
actgtctacacagagctctagttttagagctagaaatagcaagttaaaataaggctagtccgttatcaacttgaaaaagtggcaccgagtcggtgct

SEQ ID NO: 543 - RNA, 97 nt, synthetic construct
  misc_feature 1..97: note = Synthetic
  source 1..97: mol_type = other RNA
tctacacagagctctagggagttttagagctagaaatagcaagttaaaataaggctagtccgttatcaacttgaaaaagtggcaccgagtcggtgct

SEQ ID NO: 544 - RNA, 97 nt, synthetic construct
  misc_feature 1..97: note = Synthetic
  source 1..97: mol_type = other RNA
ctacacagagctctagggaagttttagagctagaaatagcaagttaaaataaggctagtccgttatcaacttgaaaaagtggcaccgagtcggtgct

SEQ ID NO: 545 - RNA, 97 nt, synthetic construct
  misc_feature 1..97: note = Synthetic
  source 1..97: mol_type = other RNA
tacacagagctctagggaaggttttagagctagaaatagcaagttaaaataaggctagtccgttatcaacttgaaaaagtggcaccgagtcggtgct

SEQ ID NO: 546 - RNA, 97 nt, synthetic construct
  misc_feature 1..97: note = Synthetic
  source 1..97: mol_type = other RNA
ggggtgtgcccagttgttaagttttagagctagaaatagcaagttaaaataaggctagtccgttatcaacttgaaaaagtggcaccgagtcggtgct

SEQ ID NO: 547 - RNA, 97 nt, synthetic construct
  misc_feature 1..97: note = Synthetic
  source 1..97: mol_type = other RNA
gggtgtgcccagttgttaatgttttagagctagaaatagcaagttaaaataaggctagtccgttatcaacttgaaaaagtggcaccgagtcggtgct

SEQ ID NO: 548 - RNA, 97 nt, synthetic construct
  misc_feature 1..97: note = Synthetic
  source 1..97: mol_type = other RNA
tggtagtcccattaacaactgttttagagctagaaatagcaagttaaaataaggctagtccgttatcaacttgaaaaagtggcaccgagtcggtgct

SEQ ID NO: 549 - RNA, 97 nt, synthetic construct
  misc_feature 1..97: note = Synthetic
  source 1..97: mol_type = other RNA
ctggtagtcccattaacaacgttttagagctagaaatagcaagttaaaataaggctagtccgttatcaacttgaaaaagtggcaccgagtcggtgct

SEQ ID NO: 550 - RNA, 97 nt, synthetic construct
  misc_feature 1..97: note = Synthetic
  source 1..97: mol_type = other RNA
ttgttaatgggactaccagagttttagagctagaaatagcaagttaaaataaggctagtccgttatcaacttgaaaaagtggcaccgagtcggtgct

SEQ ID NO: 551 - RNA, 97 nt, synthetic construct
  misc_feature 1..97: note = Synthetic
  source 1..97: mol_type = other RNA
taccagatggaagccagcttgttttagagctagaaatagcaagttaaaataaggctagtccgttatcaacttgaaaaagtggcaccgagtcggtgct

SEQ ID NO: 552 - RNA, 97 nt, synthetic construct
  misc_feature 1..97: note = Synthetic
  source 1..97: mol_type = other RNA
ttccaaagctggcttccatcgttttagagctagaaatagcaagttaaaataaggctagtccgttatcaacttgaaaaagtggcaccgagtcggtgct

SEQ ID NO: 553 - RNA, 97 nt, synthetic construct
  misc_feature 1..97: note = Synthetic
  source 1..97: mol_type = other RNA
tggaagccagctttggaagcgttttagagctagaaatagcaagttaaaataaggctagtccgttatcaacttgaaaaagtggcaccgagtcggtgct

SEQ ID NO: 554 - RNA, 97 nt, synthetic construct
  misc_feature 1..97: note = Synthetic
  source 1..97: mol_type = other RNA
acaaggcctgcttccaaagcgttttagagctagaaatagcaagttaaaataaggctagtccgttatcaacttgaaaaagtggcaccgagtcggtgct

SEQ ID NO: 555 - RNA, 97 nt, synthetic construct
  misc_feature 1..97: note = Synthetic
  source 1..97: mol_type = other RNA
gccttgttcacgtgttctaagttttagagctagaaatagcaagttaaaataaggctagtccgttatcaacttgaaaaagtggcaccgagtcggtgct

SEQ ID NO: 556 - RNA, 97 nt, synthetic construct
  misc_feature 1..97: note = Synthetic
  source 1..97: mol_type = other RNA
ccttgttcacgtgttctaatgttttagagctagaaatagcaagttaaaataaggctagtccgttatcaacttgaaaaagtggcaccgagtcggtgct

SEQ ID NO: 557 - RNA, 97 nt, synthetic construct
  misc_feature 1..97: note = Synthetic
  source 1..97: mol_type = other RNA
cccattagaacacgtgaacagttttagagctagaaatagcaagttaaaataaggctagtccgttatcaacttgaaaaagtggcaccgagtcggtgct

SEQ ID NO: 558 - RNA, 97 nt, synthetic construct
  misc_feature 1..97: note = Synthetic
  source 1..97: mol_type = other RNA
ttggcatcacttcatatttggttttagagctagaaatagcaagttaaaataaggctagtccgttatcaacttgaaaaagtggcaccgagtcggtgct

SEQ ID NO: 559 - RNA, 97 nt, synthetic construct
  misc_feature 1..97: note = Synthetic
  source 1..97: mol_type = other RNA
cttgtgctcttggcatcactgttttagagctagaaatagcaagttaaaataaggctagtccgttatcaacttgaaaaagtggcaccgagtcggtgct

SEQ ID NO: 560 - RNA, 97 nt, synthetic construct
  misc_feature 1..97: note = Synthetic
  source 1..97: mol_type = other RNA
agcacactctcttgtgctctgttttagagctagaaatagcaagttaaaataaggctagtccgttatcaacttgaaaaagtggcaccgagtcggtgct

SEQ ID NO: 561 - RNA, 97 nt, synthetic construct
  misc_feature 1..97: note = Synthetic
  source 1..97: mol_type = other RNA
gcacaagagagtgtgctctcgttttagagctagaaatagcaagttaaaataaggctagtccgttatcaacttgaaaaagtggcaccgagtcggtgct

SEQ ID NO: 562 - RNA, 97 nt, synthetic construct
  misc_feature 1..97: note = Synthetic
  source 1..97: mol_type = other RNA
gcttaatctcacacatagaagttttagagctagaaatagcaagttaaaataaggctagtccgttatcaacttgaaaaagtggcaccgagtcggtgct

SEQ ID NO: 563 - RNA, 97 nt, synthetic construct
  misc_feature 1..97: note = Synthetic
  source 1..97: mol_type = other RNA
cttaatctcacacatagaaagttttagagctagaaatagcaagttaaaataaggctagtccgttatcaacttgaaaaagtggcaccgagtcggtgct

SEQ ID NO: 564 - RNA, 97 nt, synthetic construct
  misc_feature 1..97: note = Synthetic
  source 1..97: mol_type = other RNA
ttaatctcacacatagaaaggttttagagctagaaatagcaagttaaaataaggctagtccgttatcaacttgaaaaagtggcaccgagtcggtgct

SEQ ID NO: 565 - RNA, 97 nt, synthetic construct
  misc_feature 1..97: note = Synthetic
  source 1..97: mol_type = other RNA
aggagtgctggtttatcaacgttttagagctagaaatagcaagttaaaataaggctagtccgttatcaacttgaaaaagtggcaccgagtcggtgct

SEQ ID NO: 566 - RNA, 97 nt, synthetic construct
  misc_feature 1..97: note = Synthetic
  source 1..97: mol_type = other RNA
ttctttgacagcaggagtgcgttttagagctagaaatagcaagttaaaataaggctagtccgttatcaacttgaaaaagtggcaccgagtcggtgct

SEQ ID NO: 567 - RNA, 97 nt, synthetic construct
  misc_feature 1..97: note = Synthetic
  source 1..97: mol_type = other RNA
actctggtttctttgacagcgttttagagctagaaatagcaagttaaaataaggctagtccgttatcaacttgaaaaagtggcaccgagtcggtgct

SEQ ID NO: 568 - RNA, 97 nt, synthetic construct
  misc_feature 1..97: note = Synthetic
  source 1..97: mol_type = other RNA
accagagttgagaaaaccccgttttagagctagaaatagcaagttaaaataaggctagtccgttatcaacttgaaaaagtggcaccgagtcggtgct

SEQ ID NO: 569 - RNA, 97 nt, synthetic construct
  misc_feature 1..97: note = Synthetic
  source 1..97: mol_type = other RNA
tccaggggttttctcaactcgttttagagctagaaatagcaagttaaaataaggctagtccgttatcaacttgaaaaagtggcaccgagtcggtgct

SEQ ID NO: 570 - RNA, 97 nt, synthetic construct
  misc_feature 1..97: note = Synthetic
  source 1..97: mol_type = other RNA
cagttattaaatgaatccaggttttagagctagaaatagcaagttaaaataaggctagtccgttatcaacttgaaaaagtggcaccgagtcggtgct

SEQ ID NO: 571 - RNA, 97 nt, synthetic construct
  misc_feature 1..97: note = Synthetic
  source 1..97: mol_type = other RNA
gcagttattaaatgaatccagttttagagctagaaatagcaagttaaaataaggctagtccgttatcaacttgaaaaagtggcaccgagtcggtgct

SEQ ID NO: 572 - RNA, 97 nt, synthetic construct
  misc_feature 1..97: note = Synthetic
  source 1..97: mol_type = other RNA
ggcagttattaaatgaatccgttttagagctagaaatagcaagttaaaataaggctagtccgttatcaacttgaaaaagtggcaccgagtcggtgct

SEQ ID NO: 573 - RNA, 97 nt, synthetic construct
  misc_feature 1..97: note = Synthetic
  source 1..97: mol_type = other RNA
tggatggtaacagctacatcgttttagagctagaaatagcaagttaaaataaggctagtccgttatcaacttgaaaaagtggcaccgagtcggtgct

SEQ ID NO: 574 - RNA, 97 nt, synthetic construct
  misc_feature 1..97: note = Synthetic
  source 1..97: mol_type = other RNA
gctgttaccatccacatcctgttttagagctagaaatagcaagttaaaataaggctagtccgttatcaacttgaaaaagtggcaccgagtcggtgct

SEQ ID NO: 575 - RNA, 97 nt, synthetic construct
  misc_feature 1..97: note = Synthetic
  source 1..97: mol_type = other RNA
tcaagaaccaaggatgtggagttttagagctagaaatagcaagttaaaataaggctagtccgttatcaacttgaaaaagtggcaccgagtcggtgct

SEQ ID NO: 576 - RNA, 97 nt, synthetic construct
  misc_feature 1..97: note = Synthetic
  source 1..97: mol_type = other RNA
tccttcaagaaccaaggatggttttagagctagaaatagcaagttaaaataaggctagtccgttatcaacttgaaaaagtggcaccgagtcggtgct

SEQ ID NO: 577 - RNA, 97 nt, synthetic construct
  misc_feature 1..97: note = Synthetic
  source 1..97: mol_type = other RNA
tgagtgtccttcaagaaccagttttagagctagaaatagcaagttaaaataaggctagtccgttatcaacttgaaaaagtggcaccgagtcggtgct

SEQ ID NO: 578 - RNA, 97 nt, synthetic construct
  misc_feature 1..97: note = Synthetic
  source 1..97: mol_type = other RNA
ttttattttataactacaaggttttagagctagaaatagcaagttaaaataaggctagtccgttatcaacttgaaaaagtggcaccgagtcggtgct

SEQ ID NO: 579 - RNA, 97 nt, synthetic construct
  misc_feature 1..97: note = Synthetic
  source 1..97: mol_type = other RNA
ttgtttttaataaaaacaaggttttagagctagaaatagcaagttaaaataaggctagtccgttatcaacttgaaaaagtggcaccgagtcggtgct

SEQ ID NO: 580 - RNA, 97 nt, synthetic construct
  misc_feature 1..97: note = Synthetic
  source 1..97: mol_type = other RNA
tattatagaatgcttttgcagttttagagctagaaatagcaagttaaaataaggctagtccgttatcaacttgaaaaagtggcaccgagtcggtgct

SEQ ID NO: 581 - RNA, 97 nt, synthetic construct
  misc_feature 1..97: note = Synthetic
  source 1..97: mol_type = other RNA
caagattagtcttgatgtaggttttagagctagaaatagcaagttaaaataaggctagtccgttatcaacttgaaaaagtggcaccgagtcggtgct

SEQ ID NO: 582 - RNA, 97 nt, synthetic construct
  misc_feature 1..97: note = Synthetic
  source 1..97: mol_type = other RNA
aagattagtcttgatgtagtgttttagagctagaaatagcaagttaaaataaggctagtccgttatcaacttgaaaaagtggcaccgagtcggtgct

SEQ ID NO: 583 - RNA, 97 nt, synthetic construct
  misc_feature 1..97: note = Synthetic
  source 1..97: mol_type = other RNA
agtcttgatgtagtgggagtgttttagagctagaaatagcaagttaaaataaggctagtccgttatcaacttgaaaaagtggcaccgagtcggtgct

SEQ ID NO: 584 - RNA, 97 nt, synthetic construct
  misc_feature 1..97: note = Synthetic
  source 1..97: mol_type = other RNA
tttttctattaaaaaaaaaagttttagagctagaaatagcaagttaaaataaggctagtccgttatcaacttgaaaaagtggcaccgagtcggtgct

SEQ ID NO: 585 - RNA, 97 nt, synthetic construct
  misc_feature 1..97: note = Synthetic
  source 1..97: mol_type = other RNA
tctattaaaaaaaaaaaggcgttttagagctagaaatagcaagttaaaataaggctagtccgttatcaacttgaaaaagtggcaccgagtcggtgct

SEQ ID NO: 586 - RNA, 97 nt, synthetic construct
  misc_feature 1..97: note = Synthetic
  source 1..97: mol_type = other RNA
ctattaaaaaaaaaaaggctgttttagagctagaaatagcaagttaaaataaggctagtccgttatcaacttgaaaaagtggcaccgagtcggtgct

SEQ ID NO: 587 - RNA, 97 nt, synthetic construct
  misc_feature 1..97: note = Synthetic
  source 1..97: mol_type = other RNA
aaaaaaaaaaaggctgggcagttttagagctagaaatagcaagttaaaataaggctagtccgttatcaacttgaaaaagtggcaccgagtcggtgct

SEQ ID NO: 588 - RNA, 97 nt, synthetic construct
  misc_feature 1..97: note = Synthetic
  source 1..97: mol_type = other RNA
aaaaaaaaggctgggcacgggttttagagctagaaatagcaagttaaaataaggctagtccgttatcaacttgaaaaagtggcaccgagtcggtgct

SEQ ID NO: 589 - RNA, 97 nt, synthetic construct
  misc_feature 1..97: note = Synthetic
  source 1..97: mol_type = other RNA
cacccgtaatcccagcacttgttttagagctagaaatagcaagttaaaataaggctagtccgttatcaacttgaaaaagtggcaccgagtcggtgct

SEQ ID NO: 590 - RNA, 97 nt, synthetic construct
  misc_feature 1..97: note = Synthetic
  source 1..97: mol_type = other RNA
acccgtaatcccagcactttgttttagagctagaaatagcaagttaaaataaggctagtccgttatcaacttgaaaaagtggcaccgagtcggtgct

SEQ ID NO: 591 - RNA, 97 nt, synthetic construct
  misc_feature 1..97: note = Synthetic
  source 1..97: mol_type = other RNA
cgtaatcccagcactttggggttttagagctagaaatagcaagttaaaataaggctagtccgttatcaacttgaaaaagtggcaccgagtcggtgct

SEQ ID NO: 592 - RNA, 97 nt, synthetic construct
  misc_feature 1..97: note = Synthetic
  source 1..97: mol_type = other RNA
tcccaaagtgctgggattacgttttagagctagaaatagcaagttaaaataaggctagtccgttatcaacttgaaaaagtggcaccgagtcggtgct

SEQ ID NO: 593 - RNA, 97 nt, synthetic construct
  misc_feature 1..97: note = Synthetic
  source 1..97: mol_type = other RNA
ctcccaaagtgctgggattagttttagagctagaaatagcaagttaaaataaggctagtccgttatcaacttgaaaaagtggcaccgagtcggtgct

SEQ ID NO: 594 - RNA, 97 nt, synthetic construct
  misc_feature 1..97: note = Synthetic
  source 1..97: mol_type = other RNA
cccagcactttgggaggccggttttagagctagaaatagcaagttaaaataaggctagtccgttatcaacttgaaaaagtggcaccgagtcggtgct

SEQ ID NO: 595 - RNA, 97 nt, synthetic construct
  misc_feature 1..97: note = Synthetic
  source 1..97: mol_type = other RNA
cctcggcctcccaaagtgctgttttagagctagaaatagcaagttaaaataaggctagtccgttatcaacttgaaaaagtggcaccgagtcggtgct

SEQ ID NO: 596 - RNA, 97 nt, synthetic construct
  misc_feature 1..97: note = Synthetic
  source 1..97: mol_type = other RNA
gcactttgggaggccgaggcgttttagagctagaaatagcaagttaaaataaggctagtccgttatcaacttgaaaaagtggcaccgagtcggtgct

SEQ ID NO: 597 - RNA, 97 nt, synthetic construct
  misc_feature 1..97: note = Synthetic
  source 1..97: mol_type = other RNA
ctttgggaggccgaggcagggttttagagctagaaatagcaagttaaaataaggctagtccgttatcaacttgaaaaagtggcaccgagtcggtgct

SEQ ID NO: 598 - RNA, 97 nt, synthetic construct
  misc_feature 1..97: note = Synthetic
  source 1..97: mol_type = other RNA
gccgaggcaggtggatcacggttttagagctagaaatagcaagttaaaataaggctagtccgttatcaacttgaaaaagtggcaccgagtcggtgct

SEQ ID NO: 599 - RNA, 97 nt, synthetic construct
  misc_feature 1..97: note = Synthetic
  source 1..97: mol_type = other RNA
acctcgtgatccacctgcctgttttagagctagaaatagcaagttaaaataaggctagtccgttatcaacttgaaaaagtggcaccgagtcggtgct

SEQ ID NO: 600 - RNA, 97 nt, synthetic construct
  misc_feature 1..97: note = Synthetic
  source 1..97: mol_type = other RNA
ggcaggtggatcacgaggtcgttttagagctagaaatagcaagttaaaataaggctagtccgttatcaacttgaaaaagtggcaccgagtcggtgct

SEQ ID NO: 601 - RNA, 97 nt, synthetic construct
  misc_feature 1..97: note = Synthetic
  source 1..97: mol_type = other RNA
tcaggagatcgagaccatctgttttagagctagaaatagcaagttaaaataaggctagtccgttatcaacttgaaaaagtggcaccgagtcggtgct

SEQ ID NO: 602 - RNA, 97 nt, synthetic construct
  misc_feature 1..97: note = Synthetic
  source 1..97: mol_type = other RNA
cgagaccatcttggctaacagttttagagctagaaatagcaagttaaaataaggctagtccgttatcaacttgaaaaagtggcaccgagtcggtgct

SEQ ID NO: 603 - RNA, 97 nt, synthetic construct
  misc_feature 1..97: note = Synthetic
  source 1..97: mol_type = other RNA
tttcaccatgttagccaagagttttagagctagaaatagcaagttaaaataaggctagtccgttatcaacttgaaaaagtggcaccgagtcggtgct

SEQ ID NO: 604 - RNA, 97 nt, synthetic construct
  misc_feature 1..97: note = Synthetic
  source 1..97: mol_type = other RNA
ttgtattttttgtagagacggttttagagctagaaatagcaagttaaaataaggctagtccgttatcaacttgaaaaagtggcaccgagtcggtgct

SEQ ID NO: 605 - RNA, 97 nt, synthetic construct
  misc_feature 1..97: note = Synthetic
  source 1..97: mol_type = other RNA
tttgtattttttgtagagacgttttagagctagaaatagcaagttaaaataaggctagtccgttatcaacttgaaaaagtggcaccgagtcggtgct

SEQ ID NO: 606 - RNA, 97 nt, synthetic construct
  misc_feature 1..97: note = Synthetic
  source 1..97: mol_type = other RNA
ttttgtattttttgtagagagttttagagctagaaatagcaagttaaaataaggctagtccgttatcaacttgaaaaagtggcaccgagtcggtgct

SEQ ID NO: 607 - RNA, 97 nt, synthetic construct
  misc_feature 1..97: note = Synthetic
  source 1..97: mol_type = other RNA
aaaaaatacaaaaaattagcgttttagagctagaaatagcaagttaaaataaggctagtccgttatcaacttgaaaaagtggcaccgagtcggtgct

SEQ ID NO: 608 - RNA, 97 nt, synthetic construct
  misc_feature 1..97: note = Synthetic
  source 1..97: mol_type = other RNA
aaaaatacaaaaaattagccgttttagagctagaaatagcaagttaaaataaggctagtccgttatcaacttgaaaaagtggcaccgagtcggtgct

SEQ ID NO: 609 - RNA, 97 nt, synthetic construct
  misc_feature 1..97: note = Synthetic
  source 1..97: mol_type = other RNA
tacaaaaaattagccgggtggttttagagctagaaatagcaagttaaaataaggctagtccgttatcaacttgaaaaagtggcaccgagtcggtgct

SEQ ID NO: 610 - RNA, 97 nt, synthetic construct
  misc_feature 1..97: note = Synthetic
  source 1..97: mol_type = other RNA
aaaaaattagccgggtgtgggttttagagctagaaatagcaagttaaaataaggctagtccgttatcaacttgaaaaagtggcaccgagtcggtgct

SEQ ID NO: 611 - RNA, 97 nt, synthetic construct
  misc_feature 1..97: note = Synthetic
  source 1..97: mol_type = other RNA
aaattagccgggtgtggtgggttttagagctagaaatagcaagttaaaataaggctagtccgttatcaacttgaaaaagtggcaccgagtcggtgct

SEQ ID NO: 612 - RNA, 97 nt, synthetic construct
  misc_feature 1..97: note = Synthetic
  source 1..97: mol_type = other RNA
aattagccgggtgtggtggcgttttagagctagaaatagcaagttaaaataaggctagtccgttatcaacttgaaaaagtggcaccgagtcggtgct

SEQ ID NO: 613 - RNA, 97 nt, synthetic construct
  misc_feature 1..97: note = Synthetic
  source 1..97: mol_type = other RNA
caggcgcccgccaccacaccgttttagagctagaaatagcaagttaaaataaggctagtccgttatcaacttgaaaaagtggcaccgagtcggtgct

SEQ ID NO: 614 - RNA, 97 nt, synthetic construct
  misc_feature 1..97: note = Synthetic
  source 1..97: mol_type = other RNA
gcctgtagtcccagctactcgttttagagctagaaatagcaagttaaaataaggctagtccgttatcaacttgaaaaagtggcaccgagtcggtgct

SEQ ID NO: 615 - RNA, 97 nt, synthetic construct
  misc_feature 1..97: note = Synthetic
  source 1..97: mol_type = other RNA
tgtagtcccagctactcagggttttagagctagaaatagcaagttaaaataaggctagtccgttatcaacttgaaaaagtggcaccgagtcggtgct

SEQ ID NO: 616 - RNA, 97 nt, synthetic construct
  misc_feature 1..97: note = Synthetic
  source 1..97: mol_type = other RNA
tcctgagtagctgggactacgttttagagctagaaatagcaagttaaaataaggctagtccgttatcaacttgaaaaagtggcaccgagtcggtgct

SEQ ID NO: 617 - RNA, 97 nt, synthetic construct
  misc_feature 1..97: note = Synthetic
  source 1..97: mol_type = other RNA
cccagctactcaggaggctggttttagagctagaaatagcaagttaaaataaggctagtccgttatcaacttgaaaaagtggcaccgagtcggtgct

SEQ ID NO: 618 - RNA, 97 nt, synthetic construct
  misc_feature 1..97: note = Synthetic
  source 1..97: mol_type = other RNA
cctcagcctcctgagtagctgttttagagctagaaatagcaagttaaaataaggctagtccgttatcaacttgaaaaagtggcaccgagtcggtgct

SEQ ID NO: 619 - RNA, 97 nt, synthetic construct
  misc_feature 1..97: note = Synthetic
  source 1..97: mol_type = other RNA
gcctcagcctcctgagtagcgttttagagctagaaatagcaagttaaaataaggctagtccgttatcaacttgaaaaagtggcaccgagtcggtgct

SEQ ID NO: 620 - RNA, 97 nt, synthetic construct
  misc_feature 1..97: note = Synthetic
  source 1..97: mol_type = other RNA
aggaggctgaggcaggagaagttttagagctagaaatagcaagttaaaataaggctagtccgttatcaacttgaaaaagtggcaccgagtcggtgct

SEQ ID NO: 621 - RNA, 97 nt, synthetic construct
  misc_feature 1..97: note = Synthetic
  source 1..97: mol_type = other RNA
gcaggagaatggcgtgaaccgttttagagctagaaatagcaagttaaaataaggctagtccgttatcaacttgaaaaagtggcaccgagtcggtgct

SEQ ID NO: 622 - RNA, 97 nt, synthetic construct
  misc_feature 1..97: note = Synthetic
  source 1..97: mol_type = other RNA
caggagaatggcgtgaacccgttttagagctagaaatagcaagttaaaataaggctagtccgttatcaacttgaaaaagtggcaccgagtcggtgct

SEQ ID NO: 623 - RNA, 97 nt, synthetic construct
  misc_feature 1..97: note = Synthetic
  source 1..97: mol_type = other RNA
gagaatggcgtgaacccggggttttagagctagaaatagcaagttaaaataaggctagtccgttatcaacttgaaaaagtggcaccgagtcggtgct

SEQ ID NO: 624 - RNA, 97 nt, synthetic construct
  misc_feature 1..97: note = Synthetic
  source 1..97: mol_type = other RNA
aatggcgtgaacccgggagggttttagagctagaaatagcaagttaaaataaggctagtccgttatcaacttgaaaaagtggcaccgagtcggtgct

SEQ ID NO: 625 - RNA, 97 nt, synthetic construct
  misc_feature 1..97: note = Synthetic
  source 1..97: mol_type = other RNA
cactgcaagctccacctcccgttttagagctagaaatagcaagttaaaataaggctagtccgttatcaacttgaaaaagtggcaccgagtcggtgct

SEQ ID NO: 626 - RNA, 97 nt, synthetic construct
  misc_feature 1..97: note = Synthetic
  source 1..97: mol_type = other RNA
tcactgcaagctccacctccgttttagagctagaaatagcaagttaaaataaggctagtccgttatcaacttgaaaaagtggcaccgagtcggtgct

SEQ ID NO: 627 - RNA, 97 nt, synthetic construct
  misc_feature 1..97: note = Synthetic
  source 1..97: mol_type = other RNA
cataccactgcactccagccgttttagagctagaaatagcaagttaaaataaggctagtccgttatcaacttgaaaaagtggcaccgagtcggtgct

SEQ ID NO: 628 - RNA, 97 nt, synthetic construct
  misc_feature 1..97: note = Synthetic
  source 1..97: mol_type = other RNA
ataccactgcactccagcctgttttagagctagaaatagcaagttaaaataaggctagtccgttatcaacttgaaaaagtggcaccgagtcggtgct

SEQ ID NO: 629 - RNA, 97 nt, synthetic construct
  misc_feature 1..97: note = Synthetic
  source 1..97: mol_type = other RNA
tcgcccaggctggagtgcaggttttagagctagaaatagcaagttaaaataaggctagtccgttatcaacttgaaaaagtggcaccgagtcggtgct

SEQ ID NO: 630 - RNA, 97 nt, synthetic construct
  misc_feature 1..97: note = Synthetic
  source 1..97: mol_type = other RNA
tctcactctttcgcccaggcgttttagagctagaaatagcaagttaaaataaggctagtccgttatcaacttgaaaaagtggcaccgagtcggtgct

SEQ ID NO: 631 - RNA, 97 nt, synthetic construct
  misc_feature 1..97: note = Synthetic
  source 1..97: mol_type = other RNA
ggagtctcactctttcgcccgttttagagctagaaatagcaagttaaaataaggctagtccgttatcaacttgaaaaagtggcaccgagtcggtgct

SEQ ID NO: 632 - RNA, 97 nt, synthetic construct
  misc_feature 1..97: note = Synthetic
  source 1..97: mol_type = other RNA
tgttttttgtttttttgagagttttagagctagaaatagcaagttaaaataaggctagtccgttatcaacttgaaaaagtggcaccgagtcggtgct

SEQ ID NO: 633 - RNA, 97 nt, synthetic construct
  misc_feature 1..97: note = Synthetic
  source 1..97: mol_type = other RNA
aggaagaaagaaaggtttttgttttagagctagaaatagcaagttaaaataaggctagtccgttatcaacttgaaaaagtggcaccgagtcggtgct

SEQ ID NO: 634 - RNA, 97 nt, synthetic construct
  misc_feature 1..97: note = Synthetic
  source 1..97: mol_type = other RNA
agaagaaaaggaagaaagaagttttagagctagaaatagcaagttaaaataaggctagtccgttatcaacttgaaaaagtggcaccgagtcggtgct

SEQ ID NO: 635 - RNA, 97 nt, synthetic construct
  misc_feature 1..97: note = Synthetic
  source 1..97: mol_type = other RNA
ctttcttccttttcttctctgttttagagctagaaatagcaagttaaaataaggctagtccgttatcaacttgaaaaagtggcaccgagtcggtgct

SEQ ID NO: 636 - RNA, 97 nt, synthetic construct
  misc_feature 1..97: note = Synthetic
  source 1..97: mol_type = other RNA
tttcttccttttcttctcttgttttagagctagaaatagcaagttaaaataaggctagtccgttatcaacttgaaaaagtggcaccgagtcggtgct

SEQ ID NO: 637 - RNA, 97 nt, synthetic construct
  misc_feature 1..97: note = Synthetic
  source 1..97: mol_type = other RNA
aatggacccaagagaagaaagttttagagctagaaatagcaagttaaaataaggctagtccgttatcaacttgaaaaagtggcaccgagtcggtgct

SEQ ID NO: 638 - RNA, 97 nt, synthetic construct
  misc_feature 1..97: note = Synthetic
  source 1..97: mol_type = other RNA
ggctattacataagaaacaagttttagagctagaaatagcaagttaaaataaggctagtccgttatcaacttgaaaaagtggcaccgagtcggtgct

SEQ ID NO: 639 - RNA, 97 nt, synthetic construct
  misc_feature 1..97: note = Synthetic
  source 1..97: mol_type = other RNA
cacaggaaaaggaactgtacgttttagagctagaaatagcaagttaaaataaggctagtccgttatcaacttgaaaaagtggcaccgagtcggtgct

SEQ ID NO: 640 - RNA, 97 nt, synthetic construct
  misc_feature 1..97: note = Synthetic
  source 1..97: mol_type = other RNA
attaaagctaacacaggaaagttttagagctagaaatagcaagttaaaataaggctagtccgttatcaacttgaaaaagtggcaccgagtcggtgct

SEQ ID NO: 641 - RNA, 97 nt, synthetic construct
  misc_feature 1..97: note = Synthetic
  source 1..97: mol_type = other RNA
tcaaaaattaaagctaacacgttttagagctagaaatagcaagttaaaataaggctagtccgttatcaacttgaaaaagtggcaccgagtcggtgct

SEQ ID NO: 642 - RNA, 97 nt, synthetic construct
  misc_feature 1..97: note = Synthetic
  source 1..97: mol_type = other RNA
taaaattgtctaaacatctcgttttagagctagaaatagcaagttaaaataaggctagtccgttatcaacttgaaaaagtggcaccgagtcggtgct

SEQ ID NO: 643 - RNA, 97 nt, synthetic construct
  misc_feature 1..97: note = Synthetic
  source 1..97: mol_type = other RNA
agagatgtttagacaattttgttttagagctagaaatagcaagttaaaataaggctagtccgttatcaacttgaaaaagtggcaccgagtcggtgct

SEQ ID NO: 644 - RNA, 97 nt, synthetic construct
  misc_feature 1..97: note = Synthetic
  source 1..97: mol_type = other RNA
tctaaacatctctgggaccagttttagagctagaaatagcaagttaaaataaggctagtccgttatcaacttgaaaaagtggcaccgagtcggtgct

SEQ ID NO: 645 - RNA, 97 nt, synthetic construct
  misc_feature 1..97: note = Synthetic
  source 1..97: mol_type = other RNA
tttatgctttcatatatcctgttttagagctagaaatagcaagttaaaataaggctagtccgttatcaacttgaaaaagtggcaccgagtcggtgct

SEQ ID NO: 646 - RNA, 97 nt, synthetic construct
  misc_feature 1..97: note = Synthetic
  source 1..97: mol_type = other RNA
agcataaattacaaagaaaagttttagagctagaaatagcaagttaaaataaggctagtccgttatcaacttgaaaaagtggcaccgagtcggtgct

SEQ ID NO: 647 - RNA, 97 nt, synthetic construct
  misc_feature 1..97: note = Synthetic
  source 1..97: mol_type = other RNA
tacaaagaaaaaggttatcagttttagagctagaaatagcaagttaaaataaggctagtccgttatcaacttgaaaaagtggcaccgagtcggtgct

SEQ ID NO: 648 - RNA, 97 nt, synthetic construct
  misc_feature 1..97: note = Synthetic
  source 1..97: mol_type = other RNA
acaaagaaaaaggttatcatgttttagagctagaaatagcaagttaaaataaggctagtccgttatcaacttgaaaaagtggcaccgagtcggtgct

SEQ ID NO: 649 - RNA, 97 nt, synthetic construct
  misc_feature 1..97: note = Synthetic
  source 1..97: mol_type = other RNA
caaagaaaaaggttatcatggttttagagctagaaatagcaagttaaaataaggctagtccgttatcaacttgaaaaagtggcaccgagtcggtgct

SEQ ID NO: 650 - RNA, 97 nt, synthetic construct
  misc_feature 1..97: note = Synthetic
  source 1..97: mol_type = other RNA
tctgagatttaaaatagagtgttttagagctagaaatagcaagttaaaataaggctagtccgttatcaacttgaaaaagtggcaccgagtcggtgct

SEQ ID NO: 651 - RNA, 97 nt, synthetic construct
  misc_feature 1..97: note = Synthetic
  source 1..97: mol_type = other RNA
cttataagatacattatgaagttttagagctagaaatagcaagttaaaataaggctagtccgttatcaacttgaaaaagtggcaccgagtcggtgct

SEQ ID NO: 652 - RNA, 97 nt, synthetic construct
  misc_feature 1..97: note = Synthetic
  source 1..97: mol_type = other RNA
tatcttataagactataaaagttttagagctagaaatagcaagttaaaataaggctagtccgttatcaacttgaaaaagtggcaccgagtcggtgct

SEQ ID NO: 653 - RNA, 97 nt, synthetic construct
  misc_feature 1..97: note = Synthetic
  source 1..97: mol_type = other RNA
atcttataagactataaaaagttttagagctagaaatagcaagttaaaataaggctagtccgttatcaacttgaaaaagtggcaccgagtcggtgct

SEQ ID NO: 654 - RNA, 97 nt, synthetic construct
  misc_feature 1..97: note = Synthetic
  source 1..97: mol_type = other RNA
ttataagactataaaaaggggttttagagctagaaatagcaagttaaaataaggctagtccgttatcaacttgaaaaagtggcaccgagtcggtgct

SEQ ID NO: 655 - RNA, 97 nt, synthetic construct
  misc_feature 1..97: note = Synthetic
  source 1..97: mol_type = other RNA
taaaaagggaggaaatataggttttagagctagaaatagcaagttaaaataaggctagtccgttatcaacttgaaaaagtggcaccgagtcggtgct

SEQ ID NO: 656 - RNA, 97 nt, synthetic construct
  misc_feature 1..97: note = Synthetic
  source 1..97: mol_type = other RNA
aaaaagggaggaaatatagagttttagagctagaaatagcaagttaaaataaggctagtccgttatcaacttgaaaaagtggcaccgagtcggtgct

SEQ ID NO: 657 - RNA, 97 nt, synthetic construct
  misc_feature 1..97: note = Synthetic
  source 1..97: mol_type = other RNA
aaatatagagggtccactttgttttagagctagaaatagcaagttaaaataaggctagtccgttatcaacttgaaaaagtggcaccgagtcggtgct

SEQ ID NO: 658 - RNA, 97 nt, synthetic construct
  misc_feature 1..97: note = Synthetic
  source 1..97: mol_type = other RNA
tatagagggtccacttttgggttttagagctagaaatagcaagttaaaataaggctagtccgttatcaacttgaaaaagtggcaccgagtcggtgct

SEQ ID NO: 659 - RNA, 97 nt, synthetic construct
  misc_feature 1..97: note = Synthetic
  source 1..97: mol_type = other RNA
actctgaagtccaccaaaaggttttagagctagaaatagcaagttaaaataaggctagtccgttatcaacttgaaaaagtggcaccgagtcggtgct

SEQ ID NO: 660 - RNA, 97 nt, synthetic construct
  misc_feature 1..97: note = Synthetic
  source 1..97: mol_type = other RNA
agaatagagttgcaccgtttgttttagagctagaaatagcaagttaaaataaggctagtccgttatcaacttgaaaaagtggcaccgagtcggtgct

SEQ ID NO: 661 - RNA, 97 nt, synthetic construct
  misc_feature 1..97: note = Synthetic
  source 1..97: mol_type = other RNA
aaaacggtgcaactctattcgttttagagctagaaatagcaagttaaaataaggctagtccgttatcaacttgaaaaagtggcaccgagtcggtgct

SEQ ID NO: 662 - RNA, 97 nt, synthetic construct
  misc_feature 1..97: note = Synthetic
  source 1..97: mol_type = other RNA
ccgttttgggctaatgaaaagttttagagctagaaatagcaagttaaaataaggctagtccgttatcaacttgaaaaagtggcaccgagtcggtgct

SEQ ID NO: 663 - RNA, 97 nt, synthetic construct
  misc_feature 1..97: note = Synthetic
  source 1..97: mol_type = other RNA
cctttttcattagcccaaaagttttagagctagaaatagcaagttaaaataaggctagtccgttatcaacttgaaaaagtggcaccgagtcggtgct

SEQ ID NO: 664 - RNA, 97 nt, synthetic construct
  misc_feature 1..97: note = Synthetic
  source 1..97: mol_type = other RNA
tgggctaatgaaaaaggaaggttttagagctagaaatagcaagttaaaataaggctagtccgttatcaacttgaaaaagtggcaccgagtcggtgct

SEQ ID NO: 665 - RNA, 97 nt, synthetic construct
  misc_feature 1..97: note = Synthetic
  source 1..97: mol_type = other RNA
taatgaaaaaggaagaggctgttttagagctagaaatagcaagttaaaataaggctagtccgttatcaacttgaaaaagtggcaccgagtcggtgct

SEQ ID NO: 666 - RNA, 97 nt, synthetic construct
  misc_feature 1..97: note = Synthetic
  source 1..97: mol_type = other RNA
aatgaaaaaggaagaggctagttttagagctagaaatagcaagttaaaataaggctagtccgttatcaacttgaaaaagtggcaccgagtcggtgct

SEQ ID NO: 667 - RNA, 97 nt, synthetic construct
  misc_feature 1..97: note = Synthetic
  source 1..97: mol_type = other RNA
ctgaatcttaaaatatgtccgttttagagctagaaatagcaagttaaaataaggctagtccgttatcaacttgaaaaagtggcaccgagtcggtgct

SEQ ID NO: 668 - RNA, 97 nt, synthetic construct
  misc_feature 1..97: note = Synthetic
  source 1..97: mol_type = other RNA
caggcagctttatctcaaccgttttagagctagaaatagcaagttaaaataaggctagtccgttatcaacttgaaaaagtggcaccgagtcggtgct

SEQ ID NO: 669 - RNA, 97 nt, synthetic construct
  misc_feature 1..97: note = Synthetic
  source 1..97: mol_type = other RNA
ctaagagatcaagtttcagcgttttagagctagaaatagcaagttaaaataaggctagtccgttatcaacttgaaaaagtggcaccgagtcggtgct

SEQ ID NO: 670 - RNA, 97 nt, synthetic construct
  misc_feature 1..97: note = Synthetic
  source 1..97: mol_type = other RNA
gtgttcttgttgatattctggttttagagctagaaatagcaagttaaaataaggctagtccgttatcaacttgaaaaagtggcaccgagtcggtgct

SEQ ID NO: 671 - RNA, 97 nt, synthetic construct
  misc_feature 1..97: note = Synthetic
  source 1..97: mol_type = other RNA
cttgttgatattctgtggcagttttagagctagaaatagcaagttaaaataaggctagtccgttatcaacttgaaaaagtggcaccgagtcggtgct

SEQ ID NO: 672 - RNA, 97 nt, synthetic construct
  misc_feature 1..97: note = Synthetic
  source 1..97: mol_type = other RNA
tctgtggcatggctacagatgttttagagctagaaatagcaagttaaaataaggctagtccgttatcaacttgaaaaagtggcaccgagtcggtgct

SEQ ID NO: 673 - RNA, 97 nt, synthetic construct
  misc_feature 1..97: note = Synthetic
  source 1..97: mol_type = other RNA
agaacttatttacacagggagttttagagctagaaatagcaagttaaaataaggctagtccgttatcaacttgaaaaagtggcaccgagtcggtgct

SEQ ID NO: 674 - RNA, 97 nt, synthetic construct
  misc_feature 1..97: note = Synthetic
  source 1..97: mol_type = other RNA
aaagagaacttatttacacagttttagagctagaaatagcaagttaaaataaggctagtccgttatcaacttgaaaaagtggcaccgagtcggtgct

SEQ ID NO: 675 - RNA, 97 nt, synthetic construct
  misc_feature 1..97: note = Synthetic
  source 1..97: mol_type = other RNA
caaagagaacttatttacacgttttagagctagaaatagcaagttaaaataaggctagtccgttatcaacttgaaaaagtggcaccgagtcggtgct

SEQ ID NO: 676 - RNA, 97 nt, synthetic construct
  misc_feature 1..97: note = Synthetic
  source 1..97: mol_type = other RNA
ttctctttgtatttacttttgttttagagctagaaatagcaagttaaaataaggctagtccgttatcaacttgaaaaagtggcaccgagtcggtgct

SEQ ID NO: 677 - RNA, 97 nt, synthetic construct
  misc_feature 1..97: note = Synthetic
  source 1..97: mol_type = other RNA
tctctttgtatttacttttagttttagagctagaaatagcaagttaaaataaggctagtccgttatcaacttgaaaaagtggcaccgagtcggtgct

SEQ ID NO: 678 - RNA, 97 nt, synthetic construct
  misc_feature 1..97: note = Synthetic
  source 1..97: mol_type = other RNA
ctttgtatttacttttaggggttttagagctagaaatagcaagttaaaataaggctagtccgttatcaacttgaaaaagtggcaccgagtcggtgct

SEQ ID NO: 679 - RNA, 97 nt, synthetic construct
  misc_feature 1..97: note = Synthetic
  source 1..97: mol_type = other RNA
agcttttgtccacctttaaagttttagagctagaaatagcaagttaaaataaggctagtccgttatcaacttgaaaaagtggcaccgagtcggtgct

SEQ ID NO: 680 - RNA, 97 nt, synthetic construct
  misc_feature 1..97: note = Synthetic
  source 1..97: mol_type = other RNA
tttatttttccatttaaagggttttagagctagaaatagcaagttaaaataaggctagtccgttatcaacttgaaaaagtggcaccgagtcggtgct

SEQ ID NO: 681 - RNA, 97 nt, synthetic construct
  misc_feature 1..97: note = Synthetic
  source 1..97: mol_type = other RNA
tattttatttttccatttaagttttagagctagaaatagcaagttaaaataaggctagtccgttatcaacttgaaaaagtggcaccgagtcggtgct

SEQ ID NO: 682 - RNA, 97 nt, synthetic construct
  misc_feature 1..97: note = Synthetic
  source 1..97: mol_type = other RNA
cttacataaacatacttaaagttttagagctagaaatagcaagttaaaataaggctagtccgttatcaacttgaaaaagtggcaccgagtcggtgct

SEQ ID NO: 683 - RNA, 97 nt, synthetic construct
  misc_feature 1..97: note = Synthetic
  source 1..97: mol_type = other RNA
taagcacagaagtttttaaggttttagagctagaaatagcaagttaaaataaggctagtccgttatcaacttgaaaaagtggcaccgagtcggtgct

SEQ ID NO: 684 - RNA, 97 nt, synthetic construct
  misc_feature 1..97: note = Synthetic
  source 1..97: mol_type = other RNA
aagtttttaagaggcatgaagttttagagctagaaatagcaagttaaaataaggctagtccgttatcaacttgaaaaagtggcaccgagtcggtgct

SEQ ID NO: 685 - RNA, 97 nt, synthetic construct
  misc_feature 1..97: note = Synthetic
  source 1..97: mol_type = other RNA
atatttacgtagtttttcatgttttagagctagaaatagcaagttaaaataaggctagtccgttatcaacttgaaaaagtggcaccgagtcggtgct

SEQ ID NO: 686 - RNA, 97 nt, synthetic construct
  misc_feature 1..97: note = Synthetic
  source 1..97: mol_type = other RNA
cgtaaatattcttgagaaacgttttagagctagaaatagcaagttaaaataaggctagtccgttatcaacttgaaaaagtggcaccgagtcggtgct

SEQ ID NO: 687 - RNA, 97 nt, synthetic construct
  misc_feature 1..97: note = Synthetic
  source 1..97: mol_type = other RNA
ttcttgagaaacaggaagacgttttagagctagaaatagcaagttaaaataaggctagtccgttatcaacttgaaaaagtggcaccgagtcggtgct

SEQ ID NO: 688 - RNA, 97 nt, synthetic construct
  misc_feature 1..97: note = Synthetic
  source 1..97: mol_type = other RNA
taatattaaaaacattggttgttttagagctagaaatagcaagttaaaataaggctagtccgttatcaacttgaaaaagtggcaccgagtcggtgct

SEQ ID NO: 689 - RNA, 97 nt, synthetic construct
  misc_feature 1..97: note = Synthetic
  source 1..97: mol_type = other RNA
ccaatgtttttaatattatcgttttagagctagaaatagcaagttaaaataaggctagtccgttatcaacttgaaaaagtggcaccgagtcggtgct

SEQ ID NO: 690 - RNA, 97 nt, synthetic construct
  misc_feature 1..97: note = Synthetic
  source 1..97: mol_type = other RNA
cctgataatattaaaaacatgttttagagctagaaatagcaagttaaaataaggctagtccgttatcaacttgaaaaagtggcaccgagtcggtgct

SEQ ID NO: 691 - RNA, 97 nt, synthetic construct
  misc_feature 1..97: note = Synthetic
  source 1..97: mol_type = other RNA
cattatcatgcatacatctcgttttagagctagaaatagcaagttaaaataaggctagtccgttatcaacttgaaaaagtggcaccgagtcggtgct

SEQ ID NO: 692 - RNA, 97 nt, synthetic construct
  misc_feature 1..97: note = Synthetic
  source 1..97: mol_type = other RNA
atcatgcatacatctctggcgttttagagctagaaatagcaagttaaaataaggctagtccgttatcaacttgaaaaagtggcaccgagtcggtgct

SEQ ID NO: 693 - RNA, 97 nt, synthetic construct
  misc_feature 1..97: note = Synthetic
  source 1..97: mol_type = other RNA
ttcatttcattttgattttggttttagagctagaaatagcaagttaaaataaggctagtccgttatcaacttgaaaaagtggcaccgagtcggtgct

SEQ ID NO: 694 - RNA, 97 nt, synthetic construct
  misc_feature 1..97: note = Synthetic
  source 1..97: mol_type = other RNA
attcaatttgaagcagtggtgttttagagctagaaatagcaagttaaaataaggctagtccgttatcaacttgaaaaagtggcaccgagtcggtgct

SEQ ID NO: 695 - RNA, 97 nt, synthetic construct
  misc_feature 1..97: note = Synthetic
  source 1..97: mol_type = other RNA
gaatattcaatttgaagcaggttttagagctagaaatagcaagttaaaataaggctagtccgttatcaacttgaaaaagtggcaccgagtcggtgct

SEQ ID NO: 696 - RNA, 97 nt, synthetic construct
  misc_feature 1..97: note = Synthetic
  source 1..97: mol_type = other RNA
catacgatttaaaatcgctggttttagagctagaaatagcaagttaaaataaggctagtccgttatcaacttgaaaaagtggcaccgagtcggtgct

SEQ ID NO: 697 - RNA, 97 nt, synthetic construct
  misc_feature 1..97: note = Synthetic
  source 1..97: mol_type = other RNA
aaaatcgctgaggcgcgttcgttttagagctagaaatagcaagttaaaataaggctagtccgttatcaacttgaaaaagtggcaccgagtcggtgct

SEQ ID NO: 698 - RNA, 97 nt, synthetic construct
  misc_feature 1..97: note = Synthetic
  source 1..97: mol_type = other RNA
tttttttttcttttttgtacgttttagagctagaaatagcaagttaaaataaggctagtccgttatcaacttgaaaaagtggcaccgagtcggtgct

SEQ ID NO: 699 - RNA, 97 nt, synthetic construct
  misc_feature 1..97: note = Synthetic
  source 1..97: mol_type = other RNA
ctgttgtcaaagattttaaagttttagagctagaaatagcaagttaaaataaggctagtccgttatcaacttgaaaaagtggcaccgagtcggtgct

SEQ ID NO: 700 - RNA, 97 nt, synthetic construct
  misc_feature 1..97: note = Synthetic
  source 1..97: mol_type = other RNA
tgacaacagagttctgttttgttttagagctagaaatagcaagttaaaataaggctagtccgttatcaacttgaaaaagtggcaccgagtcggtgct

SEQ ID NO: 701 - RNA, 97 nt, synthetic construct
  misc_feature 1..97: note = Synthetic
  source 1..97: mol_type = other RNA
agaatacgctgagagttatcgttttagagctagaaatagcaagttaaaataaggctagtccgttatcaacttgaaaaagtggcaccgagtcggtgct

SEQ ID NO: 702 - RNA, 97 nt, synthetic construct
  misc_feature 1..97: note = Synthetic
  source 1..97: mol_type = other RNA
gcaagagaagaaaagaacgggttttagagctagaaatagcaagttaaaataaggctagtccgttatcaacttgaaaaagtggcaccgagtcggtgct

SEQ ID NO: 703 - RNA, 97 nt, synthetic construct
  misc_feature 1..97: note = Synthetic
  source 1..97: mol_type = other RNA
gttgcaagagaagaaaagaagttttagagctagaaatagcaagttaaaataaggctagtccgttatcaacttgaaaaagtggcaccgagtcggtgct

SEQ ID NO: 704 - RNA, 97 nt, synthetic construct
  misc_feature 1..97: note = Synthetic
  source 1..97: mol_type = other RNA
atgcacacgtaaaagagagggttttagagctagaaatagcaagttaaaataaggctagtccgttatcaacttgaaaaagtggcaccgagtcggtgct

SEQ ID NO: 705 - RNA, 97 nt, synthetic construct
  misc_feature 1..97: note = Synthetic
  source 1..97: mol_type = other RNA
aagatgcacacgtaaaagaggttttagagctagaaatagcaagttaaaataaggctagtccgttatcaacttgaaaaagtggcaccgagtcggtgct

SEQ ID NO: 706 - RNA, 97 nt, synthetic construct; identical to SEQ ID NO: 692
  misc_feature 1..97: note = Synthetic
  source 1..97: mol_type = other RNA

SEQ ID NO: 707 - RNA, 97 nt, synthetic construct; identical to SEQ ID NO: 693
  misc_feature 1..97: note = Synthetic
  source 1..97: mol_type = other RNA

SEQ ID NO: 708 - RNA, 97 nt, synthetic construct; identical to SEQ ID NO: 694
  misc_feature 1..97: note = Synthetic
  source 1..97: mol_type = other RNA

SEQ ID NO: 709 - RNA, 97 nt, synthetic construct; identical to SEQ ID NO: 695
  misc_feature 1..97: note = Synthetic
  source 1..97: mol_type = other RNA

SEQ ID NO: 710 - RNA, 97 nt, synthetic construct; identical to SEQ ID NO: 696
  misc_feature 1..97: note = Synthetic
  source 1..97: mol_type = other RNA

SEQ ID NO: 711 - RNA, 97 nt, synthetic construct; identical to SEQ ID NO: 697
  misc_feature 1..97: note = Synthetic
  source 1..97: mol_type = other RNA

SEQ ID NO: 712 - RNA, 97 nt, synthetic construct; identical to SEQ ID NO: 698
  misc_feature 1..97: note = Synthetic
  source 1..97: mol_type = other RNA

SEQ ID NO: 713 - RNA, 97 nt, synthetic construct; identical to SEQ ID NO: 699
  misc_feature 1..97: note = Synthetic
  source 1..97: mol_type = other RNA

SEQ ID NO: 714 - RNA, 97 nt, synthetic construct; identical to SEQ ID NO: 700
  misc_feature 1..97: note = Synthetic
  source 1..97: mol_type = other RNA

SEQ ID NO: 715 - RNA, 97 nt, synthetic construct; identical to SEQ ID NO: 701
  misc_feature 1..97: note = Synthetic
  source 1..97: mol_type = other RNA

SEQ ID NO: 716 - RNA, 97 nt, synthetic construct; identical to SEQ ID NO: 702
  misc_feature 1..97: note = Synthetic
  source 1..97: mol_type = other RNA

SEQ ID NO: 717 - RNA, 97 nt, synthetic construct; identical to SEQ ID NO: 703
  misc_feature 1..97: note = Synthetic
  source 1..97: mol_type = other RNA

SEQ ID NO: 718 - RNA, 97 nt, synthetic construct; identical to SEQ ID NO: 704
  misc_feature 1..97: note = Synthetic
  source 1..97: mol_type = other RNA

SEQ ID NO: 719 - RNA, 97 nt, synthetic construct; identical to SEQ ID NO: 705
  misc_feature 1..97: note = Synthetic
  source 1..97: mol_type = other RNA

SEQ ID NO: 720 - RNA, 97 nt, synthetic construct
  misc_feature 1..97: note = Synthetic
  source 1..97: mol_type = other RNA
ggcagaccgttctcatcacggttttagagctagaaatagcaagttaaaataaggctagtccgttatcaacttgaaaaagtggcaccgagtcggtgct

SEQ ID NO: 721 - RNA, 97 nt, synthetic construct
  misc_feature 1..97: note = Synthetic
  source 1..97: mol_type = other RNA
ctttaccagtgactccaggtgttttagagctagaaatagcaagttaaaataaggctagtccgttatcaacttgaaaaagtggcaccgagtcggtgct

SEQ ID NO: 722 - RNA, 97 nt, synthetic construct
  misc_feature 1..97: note = Synthetic
  source 1..97: mol_type = other RNA
gtcacagatttccttctccggttttagagctagaaatagcaagttaaaataaggctagtccgttatcaacttgaaaaagtggcaccgagtcggtgct

SEQ ID NO: 723 - RNA, 97 nt, synthetic construct
  misc_feature 1..97: note = Synthetic
  source 1..97: mol_type = other RNA
agatgatgacgcccaccagagttttagagctagaaatagcaagttaaaataaggctagtccgttatcaacttgaaaaagtggcaccgagtcggtgct

SEQ ID NO: 724 - RNA, 97 nt, synthetic construct
  misc_feature 1..97: note = Synthetic
  source 1..97: mol_type = other RNA
ggagaaggaaatctgtgaccgttttagagctagaaatagcaagttaaaataaggctagtccgttatcaacttgaaaaagtggcaccgagtcggtgct

SEQ ID NO: 725 - RNA, 97 nt, synthetic construct
  misc_feature 1..97: note = Synthetic
  source 1..97: mol_type = other RNA
tgcgaggaacttacttttccgttttagagctagaaatagcaagttaaaataaggctagtccgttatcaacttgaaaaagtggcaccgagtcggtgct

SEQ ID NO: 726 - RNA, 97 nt, synthetic construct
  misc_feature 1..97: note = Synthetic
  source 1..97: mol_type = other RNA
agagaaatattgatataggagttttagagctagaaatagcaagttaaaataaggctagtccgttatcaacttgaaaaagtggcaccgagtcggtgct

SEQ ID NO: 727 - RNA, 97 nt, synthetic construct
  misc_feature 1..97: note = Synthetic
  source 1..97: mol_type = other RNA
tatcaatatttctctgatccgttttagagctagaaatagcaagttaaaataaggctagtccgttatcaacttgaaaaagtggcaccgagtcggtgct

SEQ ID NO: 728 - RNA, 97 nt, synthetic construct
  misc_feature 1..97: note = Synthetic
  source 1..97: mol_type = other RNA
atcgcttttaaggcacgctcgttttagagctagaaatagcaagttaaaataaggctagtccgttatcaacttgaaaaagtggcaccgagtcggtgct

SEQ ID NO: 729 - RNA, 97 nt, synthetic construct
  misc_feature 1..97: note = Synthetic
  source 1..97: mol_type = other RNA
tatacgactgatcgcttttagttttagagctagaaatagcaagttaaaataaggctagtccgttatcaacttgaaaaagtggcaccgagtcggtgct

SEQ ID NO: 730 - RNA, 102 nt, synthetic construct
  misc_feature 1..102: note = Synthetic
  source 1..102: mol_type = other RNA
tgtcaggttagttagatgaagttggaaccattcaaaacagcatagcaagttaaaataaggctagtccgttatcaacttgaaaaagtggcaccgagtcggtgc

SEQ ID NO: 731 - RNA, 102 nt, synthetic construct
  misc_feature 1..102: note = Synthetic
  source 1..102: mol_type = other RNA
gtgtcaggttagttagatgagttggaaccattcaaaacagcatagcaagttaaaataaggctagtccgttatcaacttgaaaaagtggcaccgagtcggtgc

SEQ ID NO: 732 - RNA, 102 nt, synthetic construct
  misc_feature 1..102: note = Synthetic
  source 1..102: mol_type = other RNA
cctgacacatatacagactagttggaaccattcaaaacagcatagcaagttaaaataaggctagtccgttatcaacttgaaaaagtggcaccgagtcggtgc

SEQ ID NO: 733 - RNA, 102 nt, synthetic construct
  misc_feature 1..102: note = Synthetic
  source 1..102: mol_type = other RNA
ctgacacatatacagactaagttggaaccattcaaaacagcatagcaagttaaaataaggctagtccgttatcaacttgaaaaagtggcaccgagtcggtgc

SEQ ID NO: 734 - RNA, 102 nt, synthetic construct
  misc_feature 1..102: note = Synthetic
  source 1..102: mol_type = other RNA
ccttagtctgtatatgtgtcgttggaaccattcaaaacagcatagcaagttaaaataaggctagtccgttatcaacttgaaaaagtggcaccgagtcggtgc

SEQ ID NO: 735 - RNA, 102 nt, synthetic construct
  misc_feature 1..102: note = Synthetic
  source 1..102: mol_type = other RNA
catatacagactaagggaccgttggaaccattcaaaacagcatagcaagttaaaataaggctagtccgttatcaacttgaaaaagtggcaccgagtcggtgc

SEQ ID NO: 736 - RNA, 102 nt, synthetic construct
  misc_feature 1..102: note = Synthetic
  source 1..102: mol_type = other RNA
atatacagactaagggaccagttggaaccattcaaaacagcatagcaagttaaaataaggctagtccgttatcaacttgaaaaagtggcaccgagtcggtgc

SEQ ID NO: 737 - RNA, 102 nt, synthetic construct
  misc_feature 1..102: note = Synthetic
  source 1..102: mol_type = other RNA
tcaaagtttgataaattcccgttggaaccattcaaaacagcatagcaagttaaaataaggctagtccgttatcaacttgaaaaagtggcaccgagtcggtgc

SEQ ID NO: 738 - RNA, 102 nt, synthetic construct
  misc_feature 1..102: note = Synthetic
  source 1..102: mol_type = other RNA
aaaatacaaagataagtagagttggaaccattcaaaacagcatagcaagttaaaataaggctagtccgttatcaacttgaaaaagtggcaccgagtcggtgc

SEQ ID NO: 739 - RNA, 102 nt, synthetic construct
  misc_feature 1..102: note = Synthetic
  source 1..102: mol_type = other RNA
actctgtgactttaaaaagtgttggaaccattcaaaacagcatagcaagttaaaataaggctagtccgttatcaacttgaaaaagtggcaccgagtcggtgc

SEQ ID NO: 740 - RNA, 102 nt, synthetic construct
  misc_feature 1..102: note = Synthetic
  source 1..102: mol_type = other RNA
ggttctgtgggatattaatagttggaaccattcaaaacagcatagcaagttaaaataaggctagtccgttatcaacttgaaaaagtggcaccgagtcggtgc

SEQ ID NO: 741 - RNA, 102 nt, synthetic construct
  misc_feature 1..102: note = Synthetic
  source 1..102: mol_type = other RNA
acagagcatattggttctgtgttggaaccattcaaaacagcatagcaagttaaaataaggctagtccgttatcaacttgaaaaagtggcaccgagtcggtgc

SEQ ID NO: 742 - RNA, 102 nt, synthetic construct
  misc_feature 1..102: note = Synthetic
  source 1..102: mol_type = other RNA
gacagagcatattggttctggttggaaccattcaaaacagcatagcaagttaaaataaggctagtccgttatcaacttgaaaaagtggcaccgagtcggtgc

SEQ ID NO: 743 - RNA, 102 nt, synthetic construct
  misc_feature 1..102: note = Synthetic
  source 1..102: mol_type = other RNA
tgcaaaacgacagagcatatgttggaaccattcaaaacagcatagcaagttaaaataaggctagtccgttatcaacttgaaaaagtggcaccgagtcggtgc

SEQ ID NO: 744 - RNA, 102 nt, synthetic construct
  misc_feature 1..102: note = Synthetic
  source 1..102: mol_type = other RNA
gagctgggcatggaataggcgttggaaccattcaaaacagcatagcaagttaaaataaggctagtccgttatcaacttgaaaaagtggcaccgagtcggtgc

SEQ ID NO: 745 - RNA, 102 nt, synthetic construct
  misc_feature 1..102: note = Synthetic
  source 1..102: mol_type = other RNA
actggagctgggcatggaatgttggaaccattcaaaacagcatagcaagttaaaataaggctagtccgttatcaacttgaaaaagtggcaccgagtcggtgc

SEQ ID NO: 746 - RNA, 102 nt, synthetic construct
  misc_feature 1..102: note = Synthetic
  source 1..102: mol_type = other RNA
ctcattactggagctgggcagttggaaccattcaaaacagcatagcaagttaaaataaggctagtccgttatcaacttgaaaaagtggcaccgagtcggtgc

SEQ ID NO: 747 - RNA, 102 nt, synthetic construct
  misc_feature 1..102: note = Synthetic
  source 1..102: mol_type = other RNA
ttgttctcattactggagctgttggaaccattcaaaacagcatagcaagttaaaataaggctagtccgttatcaacttgaaaaagtggcaccgagtcggtgc

SEQ ID NO: 748 - RNA, 102 nt, synthetic construct
  misc_feature 1..102: note = Synthetic
  source 1..102: mol_type = other RNA
attgttctcattactggagcgttggaaccattcaaaacagcatagcaagttaaaataaggctagtccgttatcaacttgaaaaagtggcaccgagtcggtgc

SEQ ID NO: 749 - RNA, 102 nt, synthetic construct
  misc_feature 1..102: note = Synthetic
  source 1..102: mol_type = other RNA
ggggagattgttctcattacgttggaaccattcaaaacagcatagcaagttaaaataaggctagtccgttatcaacttgaaaaagtggcaccgagtcggtgc

SEQ ID NO: 750 - RNA, 102 nt, synthetic construct
  misc_feature 1..102: note = Synthetic
  source 1..102: mol_type = other RNA
gaggagaaaatctgtggctggttggaaccattcaaaacagcatagcaagttaaaataaggctagtccgttatcaacttgaaaaagtggcaccgagtcggtgc

SEQ ID NO: 751 - RNA, 102 nt, synthetic construct
  misc_feature 1..102: note = Synthetic
  source 1..102: mol_type = other RNA
agaggagaaaatctgtggctgttggaaccattcaaaacagcatagcaagttaaaataaggctagtccgttatcaacttgaaaaagtggcaccgagtcggtgc

SEQ ID NO: 752 - RNA, 102 nt, synthetic construct
  misc_feature 1..102: note = Synthetic
  source 1..102: mol_type = other RNA
cagaggagaaaatctgtggcgttggaaccattcaaaacagcatagcaagttaaaataaggctagtccgttatcaacttgaaaaagtggcaccgagtcggtgc

SEQ ID NO: 753 - RNA, 102 nt, synthetic construct
  misc_feature 1..102: note = Synthetic
  source 1..102: mol_type = other RNA
tcctcagaggagaaaatctggttggaaccattcaaaacagcatagcaagttaaaataaggctagtccgttatcaacttgaaaaagtggcaccgagtcggtgc

SEQ ID NO: 754 - RNA, 102 nt, synthetic construct
  misc_feature 1..102: note = Synthetic
  source 1..102: mol_type = other RNA
tgaagtttttcattcctcaggttggaaccattcaaaacagcatagcaagttaaaataaggctagtccgttatcaacttgaaaaagtggcaccgagtcggtgc

SEQ ID NO: 755 - RNA, 102 nt, synthetic construct
  misc_feature 1..102: note = Synthetic
  source 1..102: mol_type = other RNA
cttcaccaacgactccaagtgttggaaccattcaaaacagcatagcaagttaaaataaggctagtccgttatcaacttgaaaaagtggcaccgagtcggtgc

SEQ ID NO: 756 - RNA, 102 nt, synthetic construct
  misc_feature 1..102: note = Synthetic
  source 1..102: mol_type = other RNA
ctactcctacttggagtcgtgttggaaccattcaaaacagcatagcaagttaaaataaggctagtccgttatcaacttgaaaaagtggcaccgagtcggtgc

SEQ ID NO: 757 - RNA, 102 nt, synthetic construct
  misc_feature 1..102: note = Synthetic
  source 1..102: mol_type = other RNA
ctccaagtaggagtagatgagttggaaccattcaaaacagcatagcaagttaaaataaggctagtccgttatcaacttgaaaaagtggcaccgagtcggtgc

SEQ ID NO: 758 - RNA, 102 nt, synthetic construct
  misc_feature 1..102: note = Synthetic
  source 1..102: mol_type = other RNA
caccatcatctactcctactgttggaaccattcaaaacagcatagcaagttaaaataaggctagtccgttatcaacttgaaaaagtggcaccgagtcggtgc

SEQ ID NO: 759 - RNA, 102 nt, synthetic construct
  misc_feature 1..102: note = Synthetic
  source 1..102: mol_type = other RNA
tgatggtgatcagaagcagagttggaaccattcaaaacagcatagcaagttaaaataaggctagtccgttatcaacttgaaaaagtggcaccgagtcggtgc

SEQ ID NO: 760 - RNA, 102 nt, synthetic construct
  misc_feature 1..102: note = Synthetic
  source 1..102: mol_type = other RNA
tcagaagcagaaggatttctgttggaaccattcaaaacagcatagcaagttaaaataaggctagtccgttatcaacttgaaaaagtggcaccgagtcggtgc

SEQ ID NO: 761 - RNA, 102 nt, synthetic construct
  misc_feature 1..102: note = Synthetic
  source 1..102: mol_type = other RNA
gatttctaggatgatgttcagttggaaccattcaaaacagcatagcaagttaaaataaggctagtccgttatcaacttgaaaaagtggcaccgagtcggtgc

SEQ ID NO: 762 - RNA, 102 nt, synthetic construct
  misc_feature 1..102: note = Synthetic
  source 1..102: mol_type = other RNA
ttgctctgtcctcttccttcgttggaaccattcaaaacagcatagcaagttaaaataaggctagtccgttatcaacttgaaaaagtggcaccgagtcggtgc

SEQ ID NO: 763 - RNA, 102 nt, synthetic construct
  misc_feature 1..102: note = Synthetic
  source 1..102: mol_type = other RNA
aggactgaaccagaaggaaggttggaaccattcaaaacagcatagcaagttaaaataaggctagtccgttatcaacttgaaaaagtggcaccgagtcggtgc

SEQ ID NO: 764 - RNA, 102 nt, synthetic construct
  misc_feature 1..102: note = Synthetic
  source 1..102: mol_type = other RNA
tacacaaggactgaaccagagttggaaccattcaaaacagcatagcaagttaaaataaggctagtccgttatcaacttgaaaaagtggcaccgagtcggtgc

SEQ ID NO: 765 - RNA, 102 nt, synthetic construct
  misc_feature 1..102: note = Synthetic
  source 1..102: mol_type = other RNA
ttcagtccttgtgtagtcctgttggaaccattcaaaacagcatagcaagttaaaataaggctagtccgttatcaacttgaaaaagtggcaccgagtcggtgc

SEQ ID NO: 766 - RNA, 102 nt, synthetic construct
  misc_feature 1..102: note = Synthetic
  source 1..102: mol_type = other RNA
tcagtccttgtgtagtcctagttggaaccattcaaaacagcatagcaagttaaaataaggctagtccgttatcaacttgaaaaagtggcaccgagtcggtgc

SEQ ID NO: 767 - RNA, 102 nt, synthetic construct
  misc_feature 1..102: note = Synthetic
  source 1..102: mol_type = other RNA
gtccttgtgtagtcctaggggttggaaccattcaaaacagcatagcaagttaaaataaggctagtccgttatcaacttgaaaaagtggcaccgagtcggtgc

SEQ ID NO: 768 - RNA, 102 nt, synthetic construct
  misc_feature 1..102: note = Synthetic
  source 1..102: mol_type = other RNA
cttgtgtagtcctagggagggttggaaccattcaaaacagcatagcaagttaaaataaggctagtccgttatcaacttgaaaaagtggcaccgagtcggtgc

SEQ ID NO: 769 - RNA, 102 nt, synthetic construct
  misc_feature 1..102: note = Synthetic
  source 1..102: mol_type = other RNA
ctcctccctaggactacacagttggaaccattcaaaacagcatagcaagttaaaataaggctagtccgttatcaacttgaaaaagtggcaccgagtcggtgc

SEQ ID NO: 770 - RNA, 102 nt, synthetic construct
  misc_feature 1..102: note = Synthetic
  source 1..102: mol_type = other RNA
gtagacagtacctcctccctgttggaaccattcaaaacagcatagcaagttaaaataaggctagtccgttatcaacttgaaaaagtggcaccgagtcggtgc

SEQ ID NO: 771 - RNA, 102 nt, synthetic construct
  misc_feature 1..102: note = Synthetic
  source 1..102: mol_type = other RNA
tactgtctacacagagctctgttggaaccattcaaaacagcatagcaagttaaaataaggctagtccgttatcaacttgaaaaagtggcaccgagtcggtgc

SEQ ID NO: 772 - RNA, 102 nt, synthetic construct
  misc_feature 1..102: note = Synthetic
  source 1..102: mol_type = other RNA
actgtctacacagagctctagttggaaccattcaaaacagcatagcaagttaaaataaggctagtccgttatcaacttgaaaaagtggcaccgagtcggtgc

SEQ ID NO: 773 - RNA, 102 nt, synthetic construct
  misc_feature 1..102: note = Synthetic
  source 1..102: mol_type = other RNA
tctacacagagctctagggagttggaaccattcaaaacagcatagcaagttaaaataaggctagtccgttatcaacttgaaaaagtggcaccgagtcggtgc

SEQ ID NO: 774 - RNA, 102 nt, synthetic construct
  misc_feature 1..102: note = Synthetic
  source 1..102: mol_type = other RNA
ctacacagagctctagggaagttggaaccattcaaaacagcatagcaagttaaaataaggctagtccgttatcaacttgaaaaagtggcaccgagtcggtgc

SEQ ID NO: 775 - RNA, 102 nt, synthetic construct
  misc_feature 1..102: note = Synthetic
  source 1..102: mol_type = other RNA
tacacagagctctagggaaggttggaaccattcaaaacagcatagcaagttaaaataaggctagtccgttatcaacttgaaaaagtggcaccgagtcggtgc

SEQ ID NO: 776 - RNA, 102 nt, synthetic construct
  misc_feature 1..102: note = Synthetic
  source 1..102: mol_type = other RNA
ggggtgtgcccagttgttaagttggaaccattcaaaacagcatagcaagttaaaataaggctagtccgttatcaacttgaaaaagtggcaccgagtcggtgc

SEQ ID NO: 777 - RNA, 102 nt, synthetic construct
  misc_feature 1..102: note = Synthetic
  source 1..102: mol_type = other RNA
gggtgtgcccagttgttaatgttggaaccattcaaaacagcatagcaagttaaaataaggctagtccgttatcaacttgaaaaagtggcaccgagtcggtgc

SEQ ID NO: 778 - RNA, 102 nt, synthetic construct
  misc_feature 1..102: note = Synthetic
  source 1..102: mol_type = other RNA
tggtagtcccattaacaactgttggaaccattcaaaacagcatagcaagttaaaataaggctagtccgttatcaacttgaaaaagtggcaccgagtcggtgc

SEQ ID NO: 779 - RNA, 102 nt, synthetic construct
  misc_feature 1..102: note = Synthetic
  source 1..102: mol_type = other RNA
ctggtagtcccattaacaacgttggaaccattcaaaacagcatagcaagttaaaataaggctagtccgttatcaacttgaaaaagtggcaccgagtcggtgc

SEQ ID NO: 780 - RNA, 102 nt, synthetic construct
  misc_feature 1..102: note = Synthetic
  source 1..102: mol_type = other RNA
ttgttaatgggactaccagagttggaaccattcaaaacagcatagcaagttaaaataaggctagtccgttatcaacttgaaaaagtggcaccgagtcggtgc

SEQ ID NO: 781 - RNA, 102 nt, synthetic construct
  misc_feature 1..102: note = Synthetic
  source 1..102: mol_type = other RNA
taccagatggaagccagcttgttggaaccattcaaaacagcatagcaagttaaaataaggctagtccgttatcaacttgaaaaagtggcaccgagtcggtgc

SEQ ID NO: 782 - RNA, 102 nt, synthetic construct
  misc_feature 1..102: note = Synthetic
  source 1..102: mol_type = other RNA
ttccaaagctggcttccatcgttggaaccattcaaaacagcatagcaagttaaaataaggctagtccgttatcaacttgaaaaagtggcaccgagtcggtgc

SEQ ID NO: 783 - RNA, 102 nt, synthetic construct
  misc_feature 1..102: note = Synthetic
  source 1..102: mol_type = other RNA
tggaagccagctttggaagcgttggaaccattcaaaacagcatagcaagttaaaataaggctagtccgttatcaacttgaaaaagtggcaccgagtcggtgc

SEQ ID NO: 784 - RNA, 102 nt, synthetic construct
  misc_feature 1..102: note = Synthetic
  source 1..102: mol_type = other RNA
acaaggcctgcttccaaagcgttggaaccattcaaaacagcatagcaagttaaaataaggctagtccgttatcaacttgaaaaagtggcaccgagtcggtgc

SEQ ID NO: 785 - RNA, 102 nt, synthetic construct
  misc_feature 1..102: note = Synthetic
  source 1..102: mol_type = other RNA
gccttgttcacgtgttctaagttggaaccattcaaaacagcatagcaagttaaaataaggctagtccgttatcaacttgaaaaagtggcaccgagtcggtgc

SEQ ID NO: 786 - RNA, 102 nt, synthetic construct
  misc_feature 1..102: note = Synthetic
  source 1..102: mol_type = other RNA
ccttgttcacgtgttctaatgttggaaccattcaaaacagcatagcaagttaaaataaggctagtccgttatcaacttgaaaaagtggcaccgagtcggtgc

SEQ ID NO: 787 - RNA, 102 nt, synthetic construct
  misc_feature 1..102: note = Synthetic
  source 1..102: mol_type = other RNA
cccattagaacacgtgaacagttggaaccattcaaaacagcatagcaagttaaaataaggctagtccgttatcaacttgaaaaagtggcaccgagtcggtgc

SEQ ID NO: 788 - RNA, 102 nt, synthetic construct
  misc_feature 1..102: note = Synthetic
  source 1..102: mol_type = other RNA
ttggcatcacttcatatttggttggaaccattcaaaacagcatagcaagttaaaataaggctagtccgttatcaacttgaaaaagtggcaccgagtcggtgc

SEQ ID NO: 789 - RNA, 102 nt, synthetic construct
  misc_feature 1..102: note = Synthetic
  source 1..102: mol_type = other RNA
cttgtgctcttggcatcactgttggaaccattcaaaacagcatagcaagttaaaataaggctagtccgttatcaacttgaaaaagtggcaccgagtcggtgc

SEQ ID NO: 790 - RNA, 102 nt, synthetic construct
  misc_feature 1..102: note = Synthetic
  source 1..102: mol_type = other RNA
agcacactctcttgtgctctgttggaaccattcaaaacagcatagcaagttaaaataaggctagtccgttatcaacttgaaaaagtggcaccgagtcggtgc

SEQ ID NO: 791 - RNA, 102 nt, synthetic construct
  misc_feature 1..102: note = Synthetic
  source 1..102: mol_type = other RNA
gcacaagagagtgtgctctcgttggaaccattcaaaacagcatagcaagttaaaataaggctagtccgttatcaacttgaaaaagtggcaccgagtcggtgc

SEQ ID NO: 792 - RNA, 102 nt, synthetic construct
  misc_feature 1..102: note = Synthetic
  source 1..102: mol_type = other RNA
gcttaatctcacacatagaagttggaaccattcaaaacagcatagcaagttaaaataaggctagtccgttatcaacttgaaaaagtggcaccgagtcggtgc

SEQ ID NO: 793 - RNA, 102 nt, synthetic construct
  misc_feature 1..102: note = Synthetic
  source 1..102: mol_type = other RNA
cttaatctcacacatagaaagttggaaccattcaaaacagcatagcaagttaaaataaggctagtccgttatcaacttgaaaaagtggcaccgagtcggtgc

SEQ ID NO: 794 - RNA, 102 nt, synthetic construct
  misc_feature 1..102: note = Synthetic
  source 1..102: mol_type = other RNA
ttaatctcacacatagaaaggttggaaccattcaaaacagcatagcaagttaaaataaggctagtccgttatcaacttgaaaaagtggcaccgagtcggtgc

SEQ ID NO: 795 - RNA, 102 nt, synthetic construct
  misc_feature 1..102: note = Synthetic
  source 1..102: mol_type = other RNA
aggagtgctggtttatcaacgttggaaccattcaaaacagcatagcaagttaaaataaggctagtccgttatcaacttgaaaaagtggcaccgagtcggtgc

SEQ ID NO: 796 - RNA, 102 nt, synthetic construct
  misc_feature 1..102: note = Synthetic
  source 1..102: mol_type = other RNA
ttctttgacagcaggagtgcgttggaaccattcaaaacagcatagcaagttaaaataaggctagtccgttatcaacttgaaaaagtggcaccgagtcggtgc

SEQ ID NO: 797 - RNA, 102 nt, synthetic construct
  misc_feature 1..102: note = Synthetic
  source 1..102: mol_type = other RNA
actctggtttctttgacagcgttggaaccattcaaaacagcatagcaagttaaaataaggctagtccgttatcaacttgaaaaagtggcaccgagtcggtgc

SEQ ID NO: 798 - RNA, 102 nt, synthetic construct
  misc_feature 1..102: note = Synthetic
  source 1..102: mol_type = other RNA
accagagttgagaaaaccccgttggaaccattcaaaacagcatagcaagttaaaataaggctagtccgttatcaacttgaaaaagtggcaccgagtcggtgc

SEQ ID NO: 799 - RNA, 102 nt, synthetic construct
  misc_feature 1..102: note = Synthetic
  source 1..102: mol_type = other RNA
tccaggggttttctcaactcgttggaaccattcaaaacagcatagcaagttaaaataaggctagtccgttatcaacttgaaaaagtggcaccgagtcggtgc

SEQ ID NO: 800 - RNA, 102 nt, synthetic construct
  misc_feature 1..102: note = Synthetic
  source 1..102: mol_type = other RNA
cagttattaaatgaatccaggttggaaccattcaaaacagcatagcaagttaaaataaggctagtccgttatcaacttgaaaaagtggcaccgagtcggtgc

SEQ ID NO: 801 - RNA, 102 nt, synthetic construct
  misc_feature 1..102: note = Synthetic
  source 1..102: mol_type = other RNA
gcagttattaaatgaatccagttggaaccattcaaaacagcatagcaagttaaaataaggctagtccgttatcaacttgaaaaagtggcaccgagtcggtgc

SEQ ID NO: 802 - RNA, 102 nt, synthetic construct
  misc_feature 1..102: note = Synthetic
  source 1..102: mol_type = other RNA
ggcagttattaaatgaatccgttggaaccattcaaaacagcatagcaagttaaaataaggctagtccgttatcaacttgaaaaagtggcaccgagtcggtgc

SEQ ID NO: 803 - RNA, 102 nt, synthetic construct
  misc_feature 1..102: note = Synthetic
  source 1..102: mol_type = other RNA
tggatggtaacagctacatcgttggaaccattcaaaacagcatagcaagttaaaataaggctagtccgttatcaacttgaaaaagtggcaccgagtcggtgc

SEQ ID NO: 804 - RNA, 102 nt, synthetic construct
  misc_feature 1..102: note = Synthetic
  source 1..102: mol_type = other RNA
gctgttaccatccacatcctgttggaaccattcaaaacagcatagcaagttaaaataaggctagtccgttatcaacttgaaaaagtggcaccgagtcggtgc

SEQ ID NO: 805 - RNA, 102 nt, synthetic construct
  misc_feature 1..102: note = Synthetic
  source 1..102: mol_type = other RNA
tcaagaaccaaggatgtggagttggaaccattcaaaacagcatagcaagttaaaataaggctagtccgttatcaacttgaaaaagtggcaccgagtcggtgc

SEQ ID NO: 806 - RNA, 102 nt, synthetic construct
  misc_feature 1..102: note = Synthetic
  source 1..102: mol_type = other RNA
tccttcaagaaccaaggatggttggaaccattcaaaacagcatagcaagttaaaataaggctagtccgttatcaacttgaaaaagtggcaccgagtcggtgc

SEQ ID NO: 807 - RNA, 102 nt, synthetic construct
  misc_feature 1..102: note = Synthetic
  source 1..102: mol_type = other RNA
tgagtgtccttcaagaaccagttggaaccattcaaaacagcatagcaagttaaaataaggctagtccgttatcaacttgaaaaagtggcaccgagtcggtgc

SEQ ID NO: 808 - RNA, 102 nt, synthetic construct
  misc_feature 1..102: note = Synthetic
  source 1..102: mol_type = other RNA
ttttattttataactacaaggttggaaccattcaaaacagcatagcaagttaaaataaggctagtccgttatcaacttgaaaaagtggcaccgagtcggtgc

SEQ ID NO: 809 - RNA, 102 nt, synthetic construct
  misc_feature 1..102: note = Synthetic
  source 1..102: mol_type = other RNA
ttgtttttaataaaaacaaggttggaaccattcaaaacagcatagcaagttaaaataaggctagtccgttatcaacttgaaaaagtggcaccgagtcggtgc

SEQ ID NO: 810 - RNA, 102 nt, synthetic construct
  misc_feature 1..102: note = Synthetic
  source 1..102: mol_type = other RNA
tattatagaatgcttttgcagttggaaccattcaaaacagcatagcaagttaaaataaggctagtccgttatcaacttgaaaaagtggcaccgagtcggtgc

SEQ ID NO: 811 - RNA, 102 nt, synthetic construct
  misc_feature 1..102: note = Synthetic
  source 1..102: mol_type = other RNA
caagattagtcttgatgtaggttggaaccattcaaaacagcatagcaagttaaaataaggctagtccgttatcaacttgaaaaagtggcaccgagtcggtgc

SEQ ID NO: 812 - RNA, 102 nt, synthetic construct
  misc_feature 1..102: note = Synthetic
  source 1..102: mol_type = other RNA
aagattagtcttgatgtagtgttggaaccattcaaaacagcatagcaagttaaaataaggctagtccgttatcaacttgaaaaagtggcaccgagtcggtgc

SEQ ID NO: 813 - RNA, 102 nt, synthetic construct
  misc_feature 1..102: note = Synthetic
  source 1..102: mol_type = other RNA
agtcttgatgtagtgggagtgttggaaccattcaaaacagcatagcaagttaaaataaggctagtccgttatcaacttgaaaaagtggcaccgagtcggtgc

SEQ ID NO: 814 - RNA, 102 nt, synthetic construct
  misc_feature 1..102: note = Synthetic
  source 1..102: mol_type = other RNA
tttttctattaaaaaaaaaagttggaaccattcaaaacagcatagcaagttaaaataaggctagtccgttatcaacttgaaaaagtggcaccgagtcggtgc

SEQ ID NO: 815 - RNA, 102 nt, synthetic construct
  misc_feature 1..102: note = Synthetic
  source 1..102: mol_type = other RNA
tctattaaaaaaaaaaaggcgttggaaccattcaaaacagcatagcaagttaaaataaggctagtccgttatcaacttgaaaaagtggcaccgagtcggtgc

SEQ ID NO: 816 - RNA, 102 nt, synthetic construct
  misc_feature 1..102: note = Synthetic
  source 1..102: mol_type = other RNA
ctattaaaaaaaaaaaggctgttggaaccattcaaaacagcatagcaagttaaaataaggctagtccgttatcaacttgaaaaagtggcaccgagtcggtgc

SEQ ID NO: 817 - RNA, 102 nt, synthetic construct
  misc_feature 1..102: note = Synthetic
  source 1..102: mol_type = other RNA
aaaaaaaaaaaggctgggcagttggaaccattcaaaacagcatagcaagttaaaataaggctagtccgttatcaacttgaaaaagtggcaccgagtcggtgc

SEQ ID NO: 818 - RNA, 102 nt, synthetic construct
  misc_feature 1..102: note = Synthetic
  source 1..102: mol_type = other RNA
aaaaaaaaggctgggcacgggttggaaccattcaaaacagcatagcaagttaaaataaggctagtccgttatcaacttgaaaaagtggcaccgagtcggtgc

SEQ ID NO: 819 - RNA, 102 nt, synthetic construct
  misc_feature 1..102: note = Synthetic
  source 1..102: mol_type = other RNA
cacccgtaatcccagcacttgttggaaccattcaaaacagcatagcaagttaaaataaggctagtccgttatcaacttgaaaaagtggcaccgagtcggtgc

SEQ ID NO: 820 - RNA, 102 nt, synthetic construct
  misc_feature 1..102: note = Synthetic
  source 1..102: mol_type = other RNA
acccgtaatcccagcactttgttggaaccattcaaaacagcatagcaagttaaaataaggctagtccgttatcaacttgaaaaagtggcaccgagtcggtgc

SEQ ID NO: 821 - RNA, 102 nt, synthetic construct
  misc_feature 1..102: note = Synthetic
  source 1..102: mol_type = other RNA
cgtaatcccagcactttggggttggaaccattcaaaacagcatagcaagttaaaataaggctagtccgttatcaacttgaaaaagtggcaccgagtcggtgc

SEQ ID NO: 822 - RNA, 102 nt, synthetic construct
  misc_feature 1..102: note = Synthetic
  source 1..102: mol_type = other RNA
tcccaaagtgctgggattacgttggaaccattcaaaacagcatagcaagttaaaataaggctagtccgttatcaacttgaaaaagtggcaccgagtcggtgc

SEQ ID NO: 823 - RNA, 102 nt, synthetic construct
  misc_feature 1..102: note = Synthetic
  source 1..102: mol_type = other RNA
ctcccaaagtgctgggattagttggaaccattcaaaacagcatagcaagttaaaataaggctagtccgttatcaacttgaaaaagtggcaccgagtcggtgc

SEQ ID NO: 824 - RNA, 102 nt, synthetic construct
  misc_feature 1..102: note = Synthetic
  source 1..102: mol_type = other RNA
cccagcactttgggaggccggttggaaccattcaaaacagcatagcaagttaaaataaggctagtccgttatcaacttgaaaaagtggcaccgagtcggtgc

SEQ ID NO: 825 - RNA, 102 nt, synthetic construct
  misc_feature 1..102: note = Synthetic
  source 1..102: mol_type = other RNA
cctcggcctcccaaagtgctgttggaaccattcaaaacagcatagcaagttaaaataaggctagtccgttatcaacttgaaaaagtggcaccgagtcggtgc

SEQ ID NO: 826 - RNA, 102 nt, synthetic construct
  misc_feature 1..102: note = Synthetic
  source 1..102: mol_type = other RNA
gcactttgggaggccgaggcgttggaaccattcaaaacagcatagcaagttaaaataaggctagtccgttatcaacttgaaaaagtggcaccgagtcggtgc

SEQ ID NO: 827 - RNA, 102 nt, synthetic construct
  misc_feature 1..102: note = Synthetic
  source 1..102: mol_type = other RNA
ctttgggaggccgaggcagggttggaaccattcaaaacagcatagcaagttaaaataaggctagtccgttatcaacttgaaaaagtggcaccgagtcggtgc

SEQ ID NO: 828 - RNA, 102 nt, synthetic construct
  misc_feature 1..102: note = Synthetic
  source 1..102: mol_type = other RNA
gccgaggcaggtggatcacggttggaaccattcaaaacagcatagcaagttaaaataaggctagtccgttatcaacttgaaaaagtggcaccgagtcggtgc

SEQ ID NO: 829 - RNA, 102 nt, synthetic construct
  misc_feature 1..102: note = Synthetic
  source 1..102: mol_type = other RNA
acctcgtgatccacctgcctgttggaaccattcaaaacagcatagcaagttaaaataaggctagtccgttatcaacttgaaaaagtggcaccgagtcggtgc

SEQ ID NO: 830 - RNA, 102 nt, synthetic construct
  misc_feature 1..102: note = Synthetic
  source 1..102: mol_type = other RNA
ggcaggtggatcacgaggtcgttggaaccattcaaaacagcatagcaagttaaaataaggctagtccgttatcaacttgaaaaagtggcaccgagtcggtgc

SEQ ID NO: 831 - RNA, 102 nt, synthetic construct
  misc_feature 1..102: note = Synthetic
  source 1..102: mol_type = other RNA
tcaggagatcgagaccatctgttggaaccattcaaaacagcatagcaagttaaaataaggctagtccgttatcaacttgaaaaagtggcaccgagtcggtgc

SEQ ID NO: 832 - RNA, 102 nt, synthetic construct
  misc_feature 1..102: note = Synthetic
  source 1..102: mol_type = other RNA
cgagaccatcttggctaacagttggaaccattcaaaacagcatagcaagttaaaataaggctagtccgttatcaacttgaaaaagtggcaccgagtcggtgc

SEQ ID NO: 833 - RNA, 102 nt, synthetic construct
  misc_feature 1..102: note = Synthetic
  source 1..102: mol_type = other RNA
tttcaccatgttagccaagagttggaaccattcaaaacagcatagcaagttaaaataaggctagtccgttatcaacttgaaaaagtggcaccgagtcggtgc

SEQ ID NO: 834 - RNA, 102 nt, synthetic construct
  misc_feature 1..102: note = Synthetic
  source 1..102: mol_type = other RNA
ttgtattttttgtagagacggttggaaccattcaaaacagcatagcaagttaaaataaggctagtccgttatcaacttgaaaaagtggcaccgagtcggtgc

SEQ ID NO: 835 - RNA, 102 nt, synthetic construct
  misc_feature 1..102: note = Synthetic
  source 1..102: mol_type = other RNA
tttgtattttttgtagagacgttggaaccattcaaaacagcatagcaagttaaaataaggctagtccgttatcaacttgaaaaagtggcaccgagtcggtgc

SEQ ID NO: 836 - RNA, 102 nt, synthetic construct
  misc_feature 1..102: note = Synthetic
  source 1..102: mol_type = other RNA
ttttgtattttttgtagagagttggaaccattcaaaacagcatagcaagttaaaataaggctagtccgttatcaacttgaaaaagtggcaccgagtcggtgc

SEQ ID NO: 837 - RNA, 102 nt, synthetic construct
  misc_feature 1..102: note = Synthetic
  source 1..102: mol_type = other RNA
aaaaaatacaaaaaattagcgttggaaccattcaaaacagcatagcaagttaaaataaggctagtccgttatcaacttgaaaaagtggcaccgagtcggtgc

SEQ ID NO: 838 - RNA, 102 nt, synthetic construct
  misc_feature 1..102: note = Synthetic
  source 1..102: mol_type = other RNA
aaaaatacaaaaaattagccgttggaaccattcaaaacagcatagcaagttaaaataaggctagtccgttatcaacttgaaaaagtggcaccgagtcggtgc

SEQ ID NO: 839 - RNA, 102 nt, synthetic construct
  misc_feature 1..102: note = Synthetic
  source 1..102: mol_type = other RNA
tacaaaaaattagccgggtggttggaaccattcaaaacagcatagcaagttaaaataaggctagtccgttatcaacttgaaaaagtggcaccgagtcggtgc

SEQ ID NO: 840 - RNA, 102 nt, synthetic construct
  misc_feature 1..102: note = Synthetic
  source 1..102: mol_type = other RNA
aaaaaattagccgggtgtgggttggaaccattcaaaacagcatagcaagttaaaataaggctagtccgttatcaacttgaaaaagtggcaccgagtcggtgc

SEQ ID NO: 841 - RNA, 102 nt, synthetic construct
  misc_feature 1..102: note = Synthetic
  source 1..102: mol_type = other RNA
aaattagccgggtgtggtgggttggaaccattcaaaacagcatagcaagttaaaataaggctagtccgttatcaacttgaaaaagtggcaccgagtcggtgc

SEQ ID NO: 842 - RNA, 102 nt, synthetic construct
  misc_feature 1..102: note = Synthetic
  source 1..102: mol_type = other RNA
aattagccgggtgtggtggcgttggaaccattcaaaacagcatagcaagttaaaataaggctagtccgttatcaacttgaaaaagtggcaccgagtcggtgc

SEQ ID NO: 843 - RNA, 102 nt, synthetic construct
  misc_feature 1..102: note = Synthetic
  source 1..102: mol_type = other RNA
caggcgcccgccaccacaccgttggaaccattcaaaacagcatagcaagttaaaataaggctagtccgttatcaacttgaaaaagtggcaccgagtcggtgc

SEQ ID NO: 844 - RNA, 102 nt, synthetic construct
  misc_feature 1..102: note = Synthetic
  source 1..102: mol_type = other RNA
gcctgtagtcccagctactcgttggaaccattcaaaacagcatagcaagttaaaataaggctagtccgttatcaacttgaaaaagtggcaccgagtcggtgc

SEQ ID NO: 845 - RNA, 102 nt, synthetic construct
  misc_feature 1..102: note = Synthetic
  source 1..102: mol_type = other RNA
tgtagtcccagctactcagggttggaaccattcaaaacagcatagcaagttaaaataaggctagtccgttatcaacttgaaaaagtggcaccgagtcggtgc

SEQ ID NO: 846 - RNA, 102 nt, synthetic construct
  misc_feature 1..102: note = Synthetic
  source 1..102: mol_type = other RNA
tcctgagtagctgggactacgttggaaccattcaaaacagcatagcaagttaaaataaggctagtccgttatcaacttgaaaaagtggcaccgagtcggtgc

SEQ ID NO: 847 - RNA, 102 nt, synthetic construct
  misc_feature 1..102: note = Synthetic
  source 1..102: mol_type = other RNA
cccagctactcaggaggctggttggaaccattcaaaacagcatagcaagttaaaataaggctagtccgttatcaacttgaaaaagtggcaccgagtcggtgc

SEQ ID NO: 848 - RNA, 102 nt, synthetic construct
  misc_feature 1..102: note = Synthetic
  source 1..102: mol_type = other RNA
cctcagcctcctgagtagctgttggaaccattcaaaacagcatagcaagttaaaataaggctagtccgttatcaacttgaaaaagtggcaccgagtcggtgc

SEQ ID NO: 849 - RNA, 102 nt, synthetic construct
  misc_feature 1..102: note = Synthetic
  source 1..102: mol_type = other RNA
gcctcagcctcctgagtagcgttggaaccattcaaaacagcatagcaagttaaaataaggctagtccgttatcaacttgaaaaagtggcaccgagtcggtgc

SEQ ID NO: 850 - RNA, 102 nt, synthetic construct
  misc_feature 1..102: note = Synthetic
  source 1..102: mol_type = other RNA
aggaggctgaggcaggagaagttggaaccattcaaaacagcatagcaagttaaaataaggctagtccgttatcaacttgaaaaagtggcaccgagtcggtgc

SEQ ID NO: 851 - RNA, 102 nt, synthetic construct
  misc_feature 1..102: note = Synthetic
  source 1..102: mol_type = other RNA
gcaggagaatggcgtgaaccgttggaaccattcaaaacagcatagcaagttaaaataaggctagtccgttatcaacttgaaaaagtggcaccgagtcggtgc

SEQ ID NO: 852 - RNA, 102 nt, synthetic construct
  misc_feature 1..102: note = Synthetic
  source 1..102: mol_type = other RNA
caggagaatggcgtgaacccgttggaaccattcaaaacagcatagcaagttaaaataaggctagtccgttatcaacttgaaaaagtggcaccgagtcggtgc

SEQ ID NO: 853 - RNA, 102 nt, synthetic construct
  misc_feature 1..102: note = Synthetic
  source 1..102: mol_type = other RNA
gagaatggcgtgaacccggggttggaaccattcaaaacagcatagcaagttaaaataaggctagtccgttatcaacttgaaaaagtggcaccgagtcggtgc

SEQ ID NO: 854 - RNA, 102 nt, synthetic construct
  misc_feature 1..102: note = Synthetic
  source 1..102: mol_type = other RNA
aatggcgtgaacccgggagggttggaaccattcaaaacagcatagcaagttaaaataaggctagtccgttatcaacttgaaaaagtggcaccgagtcggtgc

SEQ ID NO: 855 - RNA, 102 nt, synthetic construct
  misc_feature 1..102: note = Synthetic
  source 1..102: mol_type = other RNA
cactgcaagctccacctcccgttggaaccattcaaaacagcatagcaagttaaaataaggctagtccgttatcaacttgaaaaagtggcaccgagtcggtgc

SEQ ID NO: 856 - RNA, 102 nt, synthetic construct
  misc_feature 1..102: note = Synthetic
  source 1..102: mol_type = other RNA
tcactgcaagctccacctccgttggaaccattcaaaacagcatagcaagttaaaataaggctagtccgttatcaacttgaaaaagtggcaccgagtcggtgc

SEQ ID NO: 857 - RNA, 102 nt, synthetic construct
  misc_feature 1..102: note = Synthetic
  source 1..102: mol_type = other RNA
cataccactgcactccagccgttggaaccattcaaaacagcatagcaagttaaaataaggctagtccgttatcaacttgaaaaagtggcaccgagtcggtgc

SEQ ID NO: 858 - RNA, 102 nt, synthetic construct
  misc_feature 1..102: note = Synthetic
  source 1..102: mol_type = other RNA
ataccactgcactccagcctgttggaaccattcaaaacagcatagcaagttaaaataaggctagtccgttatcaacttgaaaaagtggcaccgagtcggtgc

SEQ ID NO: 859 - RNA, 102 nt, synthetic construct
  misc_feature 1..102: note = Synthetic
  source 1..102: mol_type = other RNA
tcgcccaggctggagtgcaggttggaaccattcaaaacagcatagcaagttaaaataaggctagtccgttatcaacttgaaaaagtggcaccgagtcggtgc

SEQ ID NO: 860 - RNA, 102 nt, synthetic construct
  misc_feature 1..102: note = Synthetic
  source 1..102: mol_type = other RNA
tctcactctttcgcccaggcgttggaaccattcaaaacagcatagcaagttaaaataaggctagtccgttatcaacttgaaaaagtggcaccgagtcggtgc

SEQ ID NO: 861 - RNA, 102 nt, synthetic construct
  misc_feature 1..102: note = Synthetic
  source 1..102: mol_type = other RNA
ggagtctcactctttcgcccgttggaaccattcaaaacagcatagcaagttaaaataaggctagtccgttatcaacttgaaaaagtggcaccgagtcggtgc

SEQ ID NO: 862 - RNA, 102 nt, synthetic construct
  misc_feature 1..102: note = Synthetic
  source 1..102: mol_type = other RNA
tgttttttgtttttttgagagttggaaccattcaaaacagcatagcaagttaaaataaggctagtccgttatcaacttgaaaaagtggcaccgagtcggtgc

SEQ ID NO: 863 - RNA, 102 nt, synthetic construct
  misc_feature 1..102: note = Synthetic
  source 1..102: mol_type = other RNA
aggaagaaagaaaggtttttgttggaaccattcaaaacagcatagcaagttaaaataaggctagtccgttatcaacttgaaaaagtggcaccgagtcggtgc

SEQ ID NO: 864 - RNA, 102 nt, synthetic construct
  misc_feature 1..102: note = Synthetic
  source 1..102: mol_type = other RNA
agaagaaaaggaagaaagaagttggaaccattcaaaacagcatagcaagttaaaataaggctagtccgttatcaacttgaaaaagtggcaccgagtcggtgc

SEQ ID NO: 865 - RNA, 102 nt, synthetic construct
  misc_feature 1..102: note = Synthetic
  source 1..102: mol_type = other RNA
ctttcttccttttcttctctgttggaaccattcaaaacagcatagcaagttaaaataaggctagtccgttatcaacttgaaaaagtggcaccgagtcggtgc

SEQ ID NO: 866 - RNA, 102 nt, synthetic construct
  misc_feature 1..102: note = Synthetic
  source 1..102: mol_type = other RNA
tttcttccttttcttctcttgttggaaccattcaaaacagcatagcaagttaaaataaggctagtccgttatcaacttgaaaaagtggcaccgagtcggtgc

SEQ ID NO: 867 - RNA, 102 nt, synthetic construct
  misc_feature 1..102: note = Synthetic
  source 1..102: mol_type = other RNA
aatggacccaagagaagaaagttggaaccattcaaaacagcatagcaagttaaaataaggctagtccgttatcaacttgaaaaagtggcaccgagtcggtgc

SEQ ID NO: 868 - RNA, 102 nt, synthetic construct
  misc_feature 1..102: note = Synthetic
  source 1..102: mol_type = other RNA
ggctattacataagaaacaagttggaaccattcaaaacagcatagcaagttaaaataaggctagtccgttatcaacttgaaaaagtggcaccgagtcggtgc

SEQ ID NO: 869 - RNA, 102 nt, synthetic construct
  misc_feature 1..102: note = Synthetic
  source 1..102: mol_type = other RNA
cacaggaaaaggaactgtacgttggaaccattcaaaacagcatagcaagttaaaataaggctagtccgttatcaacttgaaaaagtggcaccgagtcggtgc

SEQ ID NO: 870 - RNA, 102 nt, synthetic construct
  misc_feature 1..102: note = Synthetic
  source 1..102: mol_type = other RNA
attaaagctaacacaggaaagttggaaccattcaaaacagcatagcaagttaaaataaggctagtccgttatcaacttgaaaaagtggcaccgagtcggtgc

SEQ ID NO: 871 - RNA, 102 nt, synthetic construct
  misc_feature 1..102: note = Synthetic
  source 1..102: mol_type = other RNA
tcaaaaattaaagctaacacgttggaaccattcaaaacagcatagcaagttaaaataaggctagtccgttatcaacttgaaaaagtggcaccgagtcggtgc

SEQ ID NO: 872 - RNA, 102 nt, synthetic construct
  misc_feature 1..102: note = Synthetic
  source 1..102: mol_type = other RNA
taaaattgtctaaacatctcgttggaaccattcaaaacagcatagcaagttaaaataaggctagtccgttatcaacttgaaaaagtggcaccgagtcggtgc

SEQ ID NO: 873 - RNA, 102 nt, synthetic construct
  misc_feature 1..102: note = Synthetic
  source 1..102: mol_type = other RNA
agagatgtttagacaattttgttggaaccattcaaaacagcatagcaagttaaaataaggctagtccgttatcaacttgaaaaagtggcaccgagtcggtgc

SEQ ID NO: 874 - RNA, 102 nt, synthetic construct
  misc_feature 1..102: note = Synthetic
  source 1..102: mol_type = other RNA
tctaaacatctctgggaccagttggaaccattcaaaacagcatagcaagttaaaataaggctagtccgttatcaacttgaaaaagtggcaccgagtcggtgc

SEQ ID NO: 875 - RNA, 102 nt, synthetic construct
  misc_feature 1..102: note = Synthetic
  source 1..102: mol_type = other RNA
tttatgctttcatatatcctgttggaaccattcaaaacagcatagcaagttaaaataaggctagtccgttatcaacttgaaaaagtggcaccgagtcggtgc

SEQ ID NO: 876 - RNA, 102 nt, synthetic construct
  misc_feature 1..102: note = Synthetic
  source 1..102: mol_type = other RNA
agcataaattacaaagaaaagttggaaccattcaaaacagcatagcaagttaaaataaggctagtccgttatcaacttgaaaaagtggcaccgagtcggtgc

SEQ ID NO: 877 - RNA, 102 nt, synthetic construct
  misc_feature 1..102: note = Synthetic
  source 1..102: mol_type = other RNA
tacaaagaaaaaggttatcagttggaaccattcaaaacagcatagcaagttaaaataaggctagtccgttatcaacttgaaaaagtggcaccgagtcggtgc

SEQ ID NO: 878 - RNA, 102 nt, synthetic construct
  misc_feature 1..102: note = Synthetic
  source 1..102: mol_type = other RNA
acaaagaaaaaggttatcatgttggaaccattcaaaacagcatagcaagttaaaataaggctagtccgttatcaacttgaaaaagtggcaccgagtcggtgc

SEQ ID NO: 879 - RNA, 102 nt, synthetic construct
  misc_feature 1..102: note = Synthetic
  source 1..102: mol_type = other RNA
caaagaaaaaggttatcatggttggaaccattcaaaacagcatagcaagttaaaataaggctagtccgttatcaacttgaaaaagtggcaccgagtcggtgc

SEQ ID NO: 880 - RNA, 102 nt, synthetic construct
  misc_feature 1..102: note = Synthetic
  source 1..102: mol_type = other RNA
tctgagatttaaaatagagtgttggaaccattcaaaacagcatagcaagttaaaataaggctagtccgttatcaacttgaaaaagtggcaccgagtcggtgc

SEQ ID NO: 881 - RNA, 102 nt, synthetic construct
  misc_feature 1..102: note = Synthetic
  source 1..102: mol_type = other RNA
cttataagatacattatgaagttggaaccattcaaaacagcatagcaagttaaaataaggctagtccgttatcaacttgaaaaagtggcaccgagtcggtgc

SEQ ID NO: 882 - RNA, 102 nt, synthetic construct
  misc_feature 1..102: note = Synthetic
  source 1..102: mol_type = other RNA
tatcttataagactataaaagttggaaccattcaaaacagcatagcaagttaaaataaggctagtccgttatcaacttgaaaaagtggcaccgagtcggtgc

SEQ ID NO: 883 - RNA, 102 nt, synthetic construct
  misc_feature 1..102: note = Synthetic
  source 1..102: mol_type = other RNA
atcttataagactataaaaagttggaaccattcaaaacagcatagcaagttaaaataaggctagtccgttatcaacttgaaaaagtggcaccgagtcggtgc

SEQ ID NO: 884 - RNA, 102 nt, synthetic construct
  misc_feature 1..102: note = Synthetic
  source 1..102: mol_type = other RNA
ttataagactataaaaaggggttggaaccattcaaaacagcatagcaagttaaaataaggctagtccgttatcaacttgaaaaagtggcaccgagtcggtgc

SEQ ID NO: 885 - RNA, 102 nt, synthetic construct
  misc_feature 1..102: note = Synthetic
  source 1..102: mol_type = other RNA
taaaaagggaggaaatataggttggaaccattcaaaacagcatagcaagttaaaataaggctagtccgttatcaacttgaaaaagtggcaccgagtcggtgc

SEQ ID NO: 886 - RNA, 102 nt, synthetic construct
  misc_feature 1..102: note = Synthetic
  source 1..102: mol_type = other RNA
aaaaagggaggaaatatagagttggaaccattcaaaacagcatagcaagttaaaataaggctagtccgttatcaacttgaaaaagtggcaccgagtcggtgc

SEQ ID NO: 887 - RNA, 102 nt, synthetic construct
  misc_feature 1..102: note = Synthetic
  source 1..102: mol_type = other RNA
aaatatagagggtccactttgttggaaccattcaaaacagcatagcaagttaaaataaggctagtccgttatcaacttgaaaaagtggcaccgagtcggtgc

SEQ ID NO: 888 - RNA, 102 nt, synthetic construct
  misc_feature 1..102: note = Synthetic
  source 1..102: mol_type = other RNA
tatagagggtccacttttgggttggaaccattcaaaacagcatagcaagttaaaataaggctagtccgttatcaacttgaaaaagtggcaccgagtcggtgc

SEQ ID NO: 889 - RNA, 102 nt, synthetic construct
  misc_feature 1..102: note = Synthetic
  source 1..102: mol_type = other RNA
actctgaagtccaccaaaaggttggaaccattcaaaacagcatagcaagttaaaataaggctagtccgttatcaacttgaaaaagtggcaccgagtcggtgc

SEQ ID NO: 890 - RNA, 102 nt, synthetic construct
  misc_feature 1..102: note = Synthetic
  source 1..102: mol_type = other RNA
agaatagagttgcaccgtttgttggaaccattcaaaacagcatagcaagttaaaataaggctagtccgttatcaacttgaaaaagtggcaccgagtcggtgc

SEQ ID NO: 891 - RNA, 102 nt, synthetic construct
  misc_feature 1..102: note = Synthetic
  source 1..102: mol_type = other RNA
aaaacggtgcaactctattcgttggaaccattcaaaacagcatagcaagttaaaataaggctagtccgttatcaacttgaaaaagtggcaccgagtcggtgc

SEQ ID NO: 892 - RNA, 102 nt, synthetic construct
  misc_feature 1..102: note = Synthetic
  source 1..102: mol_type = other RNA
ccgttttgggctaatgaaaagttggaaccattcaaaacagcatagcaagttaaaataaggctagtccgttatcaacttgaaaaagtggcaccgagtcggtgc

SEQ ID NO: 893 - RNA, 102 nt, synthetic construct
  misc_feature 1..102: note = Synthetic
  source 1..102: mol_type = other RNA
cctttttcattagcccaaaagttggaaccattcaaaacagcatagcaagttaaaataaggctagtccgttatcaacttgaaaaagtggcaccgagtcggtgc

SEQ ID NO: 894 - RNA, 102 nt, synthetic construct
  misc_feature 1..102: note = Synthetic
  source 1..102: mol_type = other RNA
tgggctaatgaaaaaggaaggttggaaccattcaaaacagcatagcaagttaaaataaggctagtccgttatcaacttgaaaaagtggcaccgagtcggtgc

SEQ ID NO: 895 - RNA, 102 nt, synthetic construct
  misc_feature 1..102: note = Synthetic
  source 1..102: mol_type = other RNA
taatgaaaaaggaagaggctgttggaaccattcaaaacagcatagcaagttaaaataaggctagtccgttatcaacttgaaaaagtggcaccgagtcggtgc

SEQ ID NO: 896 - RNA, 102 nt, synthetic construct
  misc_feature 1..102: note = Synthetic
  source 1..102: mol_type = other RNA
aatgaaaaaggaagaggctagttggaaccattcaaaacagcatagcaagttaaaataaggctagtccgttatcaacttgaaaaagtggcaccgagtcggtgc

SEQ ID NO: 897 - RNA, 102 nt, synthetic construct
  misc_feature 1..102: note = Synthetic
  source 1..102: mol_type = other RNA
ctgaatcttaaaatatgtccgttggaaccattcaaaacagcatagcaagttaaaataaggctagtccgttatcaacttgaaaaagtggcaccgagtcggtgc

SEQ ID NO: 898 - RNA, 102 nt, synthetic construct
  misc_feature 1..102: note = Synthetic
  source 1..102: mol_type = other RNA
caggcagctttatctcaaccgttggaaccattcaaaacagcatagcaagttaaaataaggctagtccgttatcaacttgaaaaagtggcaccgagtcggtgc

SEQ ID NO: 899 - RNA, 102 nt, synthetic construct
  misc_feature 1..102: note = Synthetic
  source 1..102: mol_type = other RNA
ctaagagatcaagtttcagcgttggaaccattcaaaacagcatagcaagttaaaataaggctagtccgttatcaacttgaaaaagtggcaccgagtcggtgc

SEQ ID NO: 900 - RNA, 102 nt, synthetic construct
  misc_feature 1..102: note = Synthetic
  source 1..102: mol_type = other RNA
gtgttcttgttgatattctggttggaaccattcaaaacagcatagcaagttaaaataaggctagtccgttatcaacttgaaaaagtggcaccgagtcggtgc

SEQ ID NO: 901 - RNA, 102 nt, synthetic construct
  misc_feature 1..102: note = Synthetic
  source 1..102: mol_type = other RNA
cttgttgatattctgtggcagttggaaccattcaaaacagcatagcaagttaaaataaggctagtccgttatcaacttgaaaaagtggcaccgagtcggtgc

SEQ ID NO: 902 - RNA, 102 nt, synthetic construct
  misc_feature 1..102: note = Synthetic
  source 1..102: mol_type = other RNA
tctgtggcatggctacagatgttggaaccattcaaaacagcatagcaagttaaaataaggctagtccgttatcaacttgaaaaagtggcaccgagtcggtgc

SEQ ID NO: 903 - RNA, 102 nt, synthetic construct
  misc_feature 1..102: note = Synthetic
  source 1..102: mol_type = other RNA
agaacttatttacacagggagttggaaccattcaaaacagcatagcaagttaaaataaggctagtccgttatcaacttgaaaaagtggcaccgagtcggtgc

SEQ ID NO: 904 - RNA, 102 nt, synthetic construct
  misc_feature 1..102: note = Synthetic
  source 1..102: mol_type = other RNA
aaagagaacttatttacacagttggaaccattcaaaacagcatagcaagttaaaataaggctagtccgttatcaacttgaaaaagtggcaccgagtcggtgc

SEQ ID NO: 905 - RNA, 102 nt, synthetic construct
  misc_feature 1..102: note = Synthetic
  source 1..102: mol_type = other RNA
caaagagaacttatttacacgttggaaccattcaaaacagcatagcaagttaaaataaggctagtccgttatcaacttgaaaaagtggcaccgagtcggtgc

SEQ ID NO: 906 - RNA, 102 nt, synthetic construct
  misc_feature 1..102: note = Synthetic
  source 1..102: mol_type = other RNA
ttctctttgtatttacttttgttggaaccattcaaaacagcatagcaagttaaaataaggctagtccgttatcaacttgaaaaagtggcaccgagtcggtgc

SEQ ID NO: 907 - RNA, 102 nt, synthetic construct
  misc_feature 1..102: note = Synthetic
  source 1..102: mol_type = other RNA
tctctttgtatttacttttagttggaaccattcaaaacagcatagcaagttaaaataaggctagtccgttatcaacttgaaaaagtggcaccgagtcggtgc

SEQ ID NO: 908 - RNA, 102 nt, synthetic construct
  misc_feature 1..102: note = Synthetic
  source 1..102: mol_type = other RNA
ctttgtatttacttttaggggttggaaccattcaaaacagcatagcaagttaaaataaggctagtccgttatcaacttgaaaaagtggcaccgagtcggtgc

SEQ ID NO: 909 - RNA, 102 nt, synthetic construct
  misc_feature 1..102: note = Synthetic
  source 1..102: mol_type = other RNA
agcttttgtccacctttaaagttggaaccattcaaaacagcatagcaagttaaaataaggctagtccgttatcaacttgaaaaagtggcaccgagtcggtgc

SEQ ID NO: 910 - RNA, 102 nt, synthetic construct
  misc_feature 1..102: note = Synthetic
  source 1..102: mol_type = other RNA
tttatttttccatttaaagggttggaaccattcaaaacagcatagcaagttaaaataaggctagtccgttatcaacttgaaaaagtggcaccgagtcggtgc

SEQ ID NO: 911 - RNA, 102 nt, synthetic construct
  misc_feature 1..102: note = Synthetic
  source 1..102: mol_type = other RNA
tattttatttttccatttaagttggaaccattcaaaacagcatagcaagttaaaataaggctagtccgttatcaacttgaaaaagtggcaccgagtcggtgc

SEQ ID NO: 912 - RNA, 102 nt, synthetic construct
  misc_feature 1..102: note = Synthetic
  source 1..102: mol_type = other RNA
cttacataaacatacttaaagttggaaccattcaaaacagcatagcaagttaaaataaggctagtccgttatcaacttgaaaaagtggcaccgagtcggtgc

SEQ ID NO: 913 - RNA, 102 nt, synthetic construct
  misc_feature 1..102: note = Synthetic
  source 1..102: mol_type = other RNA
taagcacagaagtttttaaggttggaaccattcaaaacagcatagcaagttaaaataaggctagtccgttatcaacttgaaaaagtggcaccgagtcggtgc

SEQ ID NO: 914 - RNA, 102 nt, synthetic construct
  misc_feature 1..102: note = Synthetic
  source 1..102: mol_type = other RNA
aagtttttaagaggcatgaagttggaaccattcaaaacagcatagcaagttaaaataaggctagtccgttatcaacttgaaaaagtggcaccgagtcggtgc

SEQ ID NO: 915 - RNA, 102 nt, synthetic construct
  misc_feature 1..102: note = Synthetic
  source 1..102: mol_type = other RNA
atatttacgtagtttttcatgttggaaccattcaaaacagcatagcaagttaaaataaggctagtccgttatcaacttgaaaaagtggcaccgagtcggtgc

SEQ ID NO: 916 - RNA, 102 nt, synthetic construct
  misc_feature 1..102: note = Synthetic
  source 1..102: mol_type = other RNA
cgtaaatattcttgagaaacgttggaaccattcaaaacagcatagcaagttaaaataaggctagtccgttatcaacttgaaaaagtggcaccgagtcggtgc

SEQ ID NO: 917 - RNA, 102 nt, synthetic construct
  misc_feature 1..102: note = Synthetic
  source 1..102: mol_type = other RNA
ttcttgagaaacaggaagacgttggaaccattcaaaacagcatagcaagttaaaataaggctagtccgttatcaacttgaaaaagtggcaccgagtcggtgc

SEQ ID NO: 918 - RNA, 102 nt, synthetic construct
  misc_feature 1..102: note = Synthetic
  source 1..102: mol_type = other RNA
taatattaaaaacattggttgttggaaccattcaaaacagcatagcaagttaaaataaggctagtccgttatcaacttgaaaaagtggcaccgagtcggtgc

SEQ ID NO: 919 - RNA, 102 nt, synthetic construct
  misc_feature 1..102: note = Synthetic
  source 1..102: mol_type = other RNA
ccaatgtttttaatattatcgttggaaccattcaaaacagcatagcaagttaaaataaggctagtccgttatcaacttgaaaaagtggcaccgagtcggtgc

SEQ ID NO: 920 - RNA, 102 nt, synthetic construct
  misc_feature 1..102: note = Synthetic
  source 1..102: mol_type = other RNA
cctgataatattaaaaacatgttggaaccattcaaaacagcatagcaagttaaaataaggctagtccgttatcaacttgaaaaagtggcaccgagtcggtgc

SEQ ID NO: 921 - RNA, 102 nt, synthetic construct
  misc_feature 1..102: note = Synthetic
  source 1..102: mol_type = other RNA
cattatcatgcatacatctcgttggaaccattcaaaacagcatagcaagttaaaataaggctagtccgttatcaacttgaaaaagtggcaccgagtcggtgc

SEQ ID NO: 922 - RNA, 102 nt, synthetic construct
  misc_feature 1..102: note = Synthetic
  source 1..102: mol_type = other RNA
atcatgcatacatctctggcgttggaaccattcaaaacagcatagcaagttaaaataaggctagtccgttatcaacttgaaaaagtggcaccgagtcggtgc

SEQ ID NO: 923 - RNA, 102 nt, synthetic construct
  misc_feature 1..102: note = Synthetic
  source 1..102: mol_type = other RNA
ttcatttcattttgattttggttggaaccattcaaaacagcatagcaagttaaaataaggctagtccgttatcaacttgaaaaagtggcaccgagtcggtgc

SEQ ID NO: 924 - RNA, 102 nt, synthetic construct
  misc_feature 1..102: note = Synthetic
  source 1..102: mol_type = other RNA
attcaatttgaagcagtggtgttggaaccattcaaaacagcatagcaagttaaaataaggctagtccgttatcaacttgaaaaagtggcaccgagtcggtgc

SEQ ID NO: 925 - RNA, 102 nt, synthetic construct
  misc_feature 1..102: note = Synthetic
  source 1..102: mol_type = other RNA
gaatattcaatttgaagcaggttggaaccattcaaaacagcatagcaagttaaaataaggctagtccgttatcaacttgaaaaagtggcaccgagtcggtgc

SEQ ID NO: 926 - RNA, 102 nt, synthetic construct
  misc_feature 1..102: note = Synthetic
  source 1..102: mol_type = other RNA
catacgatttaaaatcgctggttggaaccattcaaaacagcatagcaagttaaaataaggctagtccgttatcaacttgaaaaagtggcaccgagtcggtgc

SEQ ID NO: 927 - RNA, 102 nt, synthetic construct
  misc_feature 1..102: note = Synthetic
  source 1..102: mol_type = other RNA
aaaatcgctgaggcgcgttcgttggaaccattcaaaacagcatagcaagttaaaataaggctagtccgttatcaacttgaaaaagtggcaccgagtcggtgc

SEQ ID NO: 928 - RNA, 102 nt, synthetic construct
  misc_feature 1..102: note = Synthetic
  source 1..102: mol_type = other RNA
tttttttttcttttttgtacgttggaaccattcaaaacagcatagcaagttaaaataaggctagtccgttatcaacttgaaaaagtggcaccgagtcggtgc

SEQ ID NO: 929 - RNA, 102 nt, synthetic construct
  misc_feature 1..102: note = Synthetic
  source 1..102: mol_type = other RNA
ctgttgtcaaagattttaaagttggaaccattcaaaacagcatagcaagttaaaataaggctagtccgttatcaacttgaaaaagtggcaccgagtcggtgc

SEQ ID NO: 930 - RNA, 102 nt, synthetic construct
  misc_feature 1..102: note = Synthetic
  source 1..102: mol_type = other RNA
tgacaacagagttctgttttgttggaaccattcaaaacagcatagcaagttaaaataaggctagtccgttatcaacttgaaaaagtggcaccgagtcggtgc

SEQ ID NO: 931 - RNA, 102 nt, synthetic construct
  misc_feature 1..102: note = Synthetic
  source 1..102: mol_type = other RNA
agaatacgctgagagttatcgttggaaccattcaaaacagcatagcaagttaaaataaggctagtccgttatcaacttgaaaaagtggcaccgagtcggtgc

SEQ ID NO: 932 - RNA, 102 nt, synthetic construct
  misc_feature 1..102: note = Synthetic
  source 1..102: mol_type = other RNA
gcaagagaagaaaagaacgggttggaaccattcaaaacagcatagcaagttaaaataaggctagtccgttatcaacttgaaaaagtggcaccgagtcggtgc

SEQ ID NO: 933 - RNA, 102 nt, synthetic construct
  misc_feature 1..102: note = Synthetic
  source 1..102: mol_type = other RNA
gttgcaagagaagaaaagaagttggaaccattcaaaacagcatagcaagttaaaataaggctagtccgttatcaacttgaaaaagtggcaccgagtcggtgc

SEQ ID NO: 934 - RNA, 102 nt, synthetic construct
  misc_feature 1..102: note = Synthetic
  source 1..102: mol_type = other RNA
atgcacacgtaaaagagagggttggaaccattcaaaacagcatagcaagttaaaataaggctagtccgttatcaacttgaaaaagtggcaccgagtcggtgc

SEQ ID NO: 935 - RNA, 102 nt, synthetic construct
  misc_feature 1..102: note = Synthetic
  source 1..102: mol_type = other RNA
aagatgcacacgtaaaagaggttggaaccattcaaaacagcatagcaagttaaaataaggctagtccgttatcaacttgaaaaagtggcaccgagtcggtgc

SEQ ID NO: 936 - RNA, 102 nt, synthetic construct; identical to SEQ ID NO: 922
  misc_feature 1..102: note = Synthetic
  source 1..102: mol_type = other RNA

SEQ ID NO: 937 - RNA, 102 nt, synthetic construct; identical to SEQ ID NO: 923
  misc_feature 1..102: note = Synthetic
  source 1..102: mol_type = other RNA

SEQ ID NO: 938 - RNA, 102 nt, synthetic construct; identical to SEQ ID NO: 924
  misc_feature 1..102: note = Synthetic
  source 1..102: mol_type = other RNA

SEQ ID NO: 939 - RNA, 102 nt, synthetic construct; identical to SEQ ID NO: 925
  misc_feature 1..102: note = Synthetic
  source 1..102: mol_type = other RNA

SEQ ID NO: 940 - RNA, 102 nt, synthetic construct; identical to SEQ ID NO: 926
  misc_feature 1..102: note = Synthetic
  source 1..102: mol_type = other RNA

SEQ ID NO: 941 - RNA, 102 nt, synthetic construct; identical to SEQ ID NO: 927
  misc_feature 1..102: note = Synthetic
  source 1..102: mol_type = other RNA

SEQ ID NO: 942 - RNA, 102 nt, synthetic construct; identical to SEQ ID NO: 928
  misc_feature 1..102: note = Synthetic
  source 1..102: mol_type = other RNA

SEQ ID NO: 943 - RNA, 102 nt, synthetic construct; identical to SEQ ID NO: 929
  misc_feature 1..102: note = Synthetic
  source 1..102: mol_type = other RNA

SEQ ID NO: 944 - RNA, 102 nt, synthetic construct; identical to SEQ ID NO: 930
  misc_feature 1..102: note = Synthetic
  source 1..102: mol_type = other RNA

SEQ ID NO: 945 - RNA, 102 nt, synthetic construct; identical to SEQ ID NO: 931
  misc_feature 1..102: note = Synthetic
  source 1..102: mol_type = other RNA

SEQ ID NO: 946 - RNA, 102 nt, synthetic construct; identical to SEQ ID NO: 932
  misc_feature 1..102: note = Synthetic
  source 1..102: mol_type = other RNA

SEQ ID NO: 947 - RNA, 102 nt, synthetic construct; identical to SEQ ID NO: 933
  misc_feature 1..102: note = Synthetic
  source 1..102: mol_type = other RNA

SEQ ID NO: 948 - RNA, 102 nt, synthetic construct; identical to SEQ ID NO: 934
  misc_feature 1..102: note = Synthetic
  source 1..102: mol_type = other RNA

SEQ ID NO: 949 - RNA, 102 nt, synthetic construct; identical to SEQ ID NO: 935
  misc_feature 1..102: note = Synthetic
  source 1..102: mol_type = other RNA

SEQ ID NO: 950 - RNA, 102 nt, synthetic construct
  misc_feature 1..102: note = Synthetic
  source 1..102: mol_type = other RNA
ggcagaccgttctcatcacggttggaaccattcaaaacagcatagcaagttaaaataaggctagtccgttatcaacttgaaaaagtggcaccgagtcggtgc

SEQ ID NO: 951 - RNA, 102 nt, synthetic construct
  misc_feature 1..102: note = Synthetic
  source 1..102: mol_type = other RNA
ctttaccagtgactccaggtgttggaaccattcaaaacagcatagcaagttaaaataaggctagtccgttatcaacttgaaaaagtggcaccgagtcggtgc

SEQ ID NO: 952 - RNA, 102 nt, synthetic construct
  misc_feature 1..102: note = Synthetic
  source 1..102: mol_type = other RNA
gtcacagatttccttctccggttggaaccattcaaaacagcatagcaagttaaaataaggctagtccgttatcaacttgaaaaagtggcaccgagtcggtgc

SEQ ID NO: 953 - RNA, 102 nt, synthetic construct
  misc_feature 1..102: note = Synthetic
  source 1..102: mol_type = other RNA
agatgatgacgcccaccagagttggaaccattcaaaacagcatagcaagttaaaataaggctagtccgttatcaacttgaaaaagtggcaccgagtcggtgc

SEQ ID NO: 954 - RNA, 102 nt, synthetic construct
  misc_feature 1..102: note = Synthetic
  source 1..102: mol_type = other RNA
ggagaaggaaatctgtgaccgttggaaccattcaaaacagcatagcaagttaaaataaggctagtccgttatcaacttgaaaaagtggcaccgagtcggtgc

SEQ ID NO: 955 - RNA, 102 nt, synthetic construct
  misc_feature 1..102: note = Synthetic
  source 1..102: mol_type = other RNA
tgcgaggaacttacttttccgttggaaccattcaaaacagcatagcaagttaaaataaggctagtccgttatcaacttgaaaaagtggcaccgagtcggtgc

SEQ ID NO: 956 - RNA, 102 nt, synthetic construct
  misc_feature 1..102: note = Synthetic
  source 1..102: mol_type = other RNA
agagaaatattgatataggagttggaaccattcaaaacagcatagcaagttaaaataaggctagtccgttatcaacttgaaaaagtggcaccgagtcggtgc

SEQ ID NO: 957 - RNA, 102 nt, synthetic construct
  misc_feature 1..102: note = Synthetic
  source 1..102: mol_type = other RNA
tatcaatatttctctgatccgttggaaccattcaaaacagcatagcaagttaaaataaggctagtccgttatcaacttgaaaaagtggcaccgagtcggtgc

SEQ ID NO: 958 - RNA, 102 nt, synthetic construct
  misc_feature 1..102: note = Synthetic
  source 1..102: mol_type = other RNA
atcgcttttaaggcacgctcgttggaaccattcaaaacagcatagcaagttaaaataaggctagtccgttatcaacttgaaaaagtggcaccgagtcggtgc

SEQ ID NO: 959 - RNA, 102 nt, synthetic construct
  misc_feature 1..102: note = Synthetic
  source 1..102: mol_type = other RNA
tatacgactgatcgcttttagttggaaccattcaaaacagcatagcaagttaaaataaggctagtccgttatcaacttgaaaaagtggcaccgagtcggtgc

SEQ ID NO: 960 - RNA, 96 nt, synthetic construct
  misc_feature 1..96: note = Synthetic
  source 1..96: mol_type = other RNA
tgtcaggttagttagatgaagttttagagctagaaatagcaagttaaaataaggctagtccgttatcaacttgaaaaagtggcaccgagtcggtgc

SEQ ID NO: 961 - RNA, 96 nt, synthetic construct
  misc_feature 1..96: note = Synthetic
  source 1..96: mol_type = other RNA
gtgtcaggttagttagatgagttttagagctagaaatagcaagttaaaataaggctagtccgttatcaacttgaaaaagtggcaccgagtcggtgc

SEQ ID NO: 962 - RNA, 96 nt, synthetic construct
  misc_feature 1..96: note = Synthetic
  source 1..96: mol_type = other RNA
cctgacacatatacagactagttttagagctagaaatagcaagttaaaataaggctagtccgttatcaacttgaaaaagtggcaccgagtcggtgc

SEQ ID NO: 963 - RNA, 96 nt, synthetic construct
  misc_feature 1..96: note = Synthetic
  source 1..96: mol_type = other RNA
ctgacacatatacagactaagttttagagctagaaatagcaagttaaaataaggctagtccgttatcaacttgaaaaagtggcaccgagtcggtgc

SEQ ID NO: 964 - RNA, 96 nt, synthetic construct
  misc_feature 1..96: note = Synthetic
  source 1..96: mol_type = other RNA
ccttagtctgtatatgtgtcgttttagagctagaaatagcaagttaaaataaggctagtccgttatcaacttgaaaaagtggcaccgagtcggtgc

SEQ ID NO: 965 - RNA, 96 nt, synthetic construct
  misc_feature 1..96: note = Synthetic
  source 1..96: mol_type = other RNA
catatacagactaagggaccgttttagagctagaaatagcaagttaaaataaggctagtccgttatcaacttgaaaaagtggcaccgagtcggtgc

SEQ ID NO: 966 - RNA, 96 nt, synthetic construct
  misc_feature 1..96: note = Synthetic
  source 1..96: mol_type = other RNA
atatacagactaagggaccagttttagagctagaaatagcaagttaaaataaggctagtccgttatcaacttgaaaaagtggcaccgagtcggtgc

SEQ ID NO: 967 - RNA, 96 nt, synthetic construct
  misc_feature 1..96: note = Synthetic
  source 1..96: mol_type = other RNA
tcaaagtttgataaattcccgttttagagctagaaatagcaagttaaaataaggctagtccgttatcaacttgaaaaagtggcaccgagtcggtgc

SEQ ID NO: 968 - RNA, 96 nt, synthetic construct
  misc_feature 1..96: note = Synthetic
  source 1..96: mol_type = other RNA
aaaatacaaagataagtagagttttagagctagaaatagcaagttaaaataaggctagtccgttatcaacttgaaaaagtggcaccgagtcggtgc

SEQ ID NO: 969 - RNA, 96 nt, synthetic construct
  misc_feature 1..96: note = Synthetic
  source 1..96: mol_type = other RNA
actctgtgactttaaaaagtgttttagagctagaaatagcaagttaaaataaggctagtccgttatcaacttgaaaaagtggcaccgagtcggtgc

SEQ ID NO: 970 - RNA, 96 nt, synthetic construct
  misc_feature 1..96: note = Synthetic
  source 1..96: mol_type = other RNA
ggttctgtgggatattaatagttttagagctagaaatagcaagttaaaataaggctagtccgttatcaacttgaaaaagtggcaccgagtcggtgc

SEQ ID NO: 971 - RNA, 96 nt, synthetic construct
  misc_feature 1..96: note = Synthetic
  source 1..96: mol_type = other RNA
acagagcatattggttctgtgttttagagctagaaatagcaagttaaaataaggctagtccgttatcaacttgaaaaagtggcaccgagtcggtgc

SEQ ID NO: 972 - RNA, 96 nt, synthetic construct
  misc_feature 1..96: note = Synthetic
  source 1..96: mol_type = other RNA
gacagagcatattggttctggttttagagctagaaatagcaagttaaaataaggctagtccgttatcaacttgaaaaagtggcaccgagtcggtgc

SEQ ID NO: 973 - RNA, 96 nt, synthetic construct
  misc_feature 1..96: note = Synthetic
  source 1..96: mol_type = other RNA
tgcaaaacgacagagcatatgttttagagctagaaatagcaagttaaaataaggctagtccgttatcaacttgaaaaagtggcaccgagtcggtgc

SEQ ID NO: 974 - RNA, 96 nt, synthetic construct
  misc_feature 1..96: note = Synthetic
  source 1..96: mol_type = other RNA
gagctgggcatggaataggcgttttagagctagaaatagcaagttaaaataaggctagtccgttatcaacttgaaaaagtggcaccgagtcggtgc

SEQ ID NO: 975 - RNA, 96 nt, synthetic construct
  misc_feature 1..96: note = Synthetic
  source 1..96: mol_type = other RNA
actggagctgggcatggaatgttttagagctagaaatagcaagttaaaataaggctagtccgttatcaacttgaaaaagtggcaccgagtcggtgc

SEQ ID NO: 976 - RNA, 96 nt, synthetic construct
  misc_feature 1..96: note = Synthetic
  source 1..96: mol_type = other RNA
ctcattactggagctgggcagttttagagctagaaatagcaagttaaaataaggctagtccgttatcaacttgaaaaagtggcaccgagtcggtgc

SEQ ID NO: 977 - RNA, 96 nt, synthetic construct
  misc_feature 1..96: note = Synthetic
  source 1..96: mol_type = other RNA
ttgttctcattactggagctgttttagagctagaaatagcaagttaaaataaggctagtccgttatcaacttgaaaaagtggcaccgagtcggtgc

SEQ ID NO: 978 - RNA, 96 nt, synthetic construct
  misc_feature 1..96: note = Synthetic
  source 1..96: mol_type = other RNA
attgttctcattactggagcgttttagagctagaaatagcaagttaaaataaggctagtccgttatcaacttgaaaaagtggcaccgagtcggtgc

SEQ ID NO: 979 - RNA, 96 nt, synthetic construct
  misc_feature 1..96: note = Synthetic
  source 1..96: mol_type = other RNA
ggggagattgttctcattacgttttagagctagaaatagcaagttaaaataaggctagtccgttatcaacttgaaaaagtggcaccgagtcggtgc

SEQ ID NO: 980 - RNA, 96 nt, synthetic construct
  misc_feature 1..96: note = Synthetic
  source 1..96: mol_type = other RNA
gaggagaaaatctgtggctggttttagagctagaaatagcaagttaaaataaggctagtccgttatcaacttgaaaaagtggcaccgagtcggtgc

SEQ ID NO: 981 - RNA, 96 nt, synthetic construct
  misc_feature 1..96: note = Synthetic
  source 1..96: mol_type = other RNA
agaggagaaaatctgtggctgttttagagctagaaatagcaagttaaaataaggctagtccgttatcaacttgaaaaagtggcaccgagtcggtgc

SEQ ID NO: 982 - RNA, 96 nt, synthetic construct
  misc_feature 1..96: note = Synthetic
  source 1..96: mol_type = other RNA
cagaggagaaaatctgtggcgttttagagctagaaatagcaagttaaaataaggctagtccgttatcaacttgaaaaagtggcaccgagtcggtgc

SEQ ID NO: 983 - RNA, 96 nt, synthetic construct
  misc_feature 1..96: note = Synthetic
  source 1..96: mol_type = other RNA
tcctcagaggagaaaatctggttttagagctagaaatagcaagttaaaataaggctagtccgttatcaacttgaaaaagtggcaccgagtcggtgc

SEQ ID NO: 984 - RNA, 96 nt, synthetic construct
  misc_feature 1..96: note = Synthetic
  source 1..96: mol_type = other RNA
tgaagtttttcattcctcaggttttagagctagaaatagcaagttaaaataaggctagtccgttatcaacttgaaaaagtggcaccgagtcggtgc

SEQ ID NO: 985 - RNA, 96 nt, synthetic construct
  misc_feature 1..96: note = Synthetic
  source 1..96: mol_type = other RNA
cttcaccaacgactccaagtgttttagagctagaaatagcaagttaaaataaggctagtccgttatcaacttgaaaaagtggcaccgagtcggtgc

SEQ ID NO: 986 - RNA, 96 nt, synthetic construct
  misc_feature 1..96: note = Synthetic
  source 1..96: mol_type = other RNA
ctactcctacttggagtcgtgttttagagctagaaatagcaagttaaaataaggctagtccgttatcaacttgaaaaagtggcaccgagtcggtgc

SEQ ID NO: 987 - RNA, 96 nt, synthetic construct
  misc_feature 1..96: note = Synthetic
  source 1..96: mol_type = other RNA
ctccaagtaggagtagatgagttttagagctagaaatagcaagttaaaataaggctagtccgttatcaacttgaaaaagtggcaccgagtcggtgc

SEQ ID NO: 988 - RNA, 96 nt, synthetic construct
  misc_feature 1..96: note = Synthetic
  source 1..96: mol_type = other RNA
caccatcatctactcctactgttttagagctagaaatagcaagttaaaataaggctagtccgttatcaacttgaaaaagtggcaccgagtcggtgc

SEQ ID NO: 989 - RNA, 96 nt, synthetic construct
  misc_feature 1..96: note = Synthetic
  source 1..96: mol_type = other RNA
tgatggtgatcagaagcagagttttagagctagaaatagcaagttaaaataaggctagtccgttatcaacttgaaaaagtggcaccgagtcggtgc

SEQ ID NO: 990 - RNA, 96 nt, synthetic construct
  misc_feature 1..96: note = Synthetic
  source 1..96: mol_type = other RNA
tcagaagcagaaggatttctgttttagagctagaaatagcaagttaaaataaggctagtccgttatcaacttgaaaaagtggcaccgagtcggtgc

SEQ ID NO: 991 - RNA, 96 nt, synthetic construct
  misc_feature 1..96: note = Synthetic
  source 1..96: mol_type = other RNA
gatttctaggatgatgttcagttttagagctagaaatagcaagttaaaataaggctagtccgttatcaacttgaaaaagtggcaccgagtcggtgc

SEQ ID NO: 992 - RNA, 96 nt, synthetic construct
  misc_feature 1..96: note = Synthetic
  source 1..96: mol_type = other RNA
ttgctctgtcctcttccttcgttttagagctagaaatagcaagttaaaataaggctagtccgttatcaacttgaaaaagtggcaccgagtcggtgc

SEQ ID NO: 993 - RNA, 96 nt, synthetic construct
  misc_feature 1..96: note = Synthetic
  source 1..96: mol_type = other RNA
aggactgaaccagaaggaaggttttagagctagaaatagcaagttaaaataaggctagtccgttatcaacttgaaaaagtggcaccgagtcggtgc

SEQ ID NO: 994 - RNA, 96 nt, synthetic construct
  misc_feature 1..96: note = Synthetic
  source 1..96: mol_type = other RNA
tacacaaggactgaaccagagttttagagctagaaatagcaagttaaaataaggctagtccgttatcaacttgaaaaagtggcaccgagtcggtgc

SEQ ID NO: 995 - RNA, 96 nt, synthetic construct
  misc_feature 1..96: note = Synthetic
  source 1..96: mol_type = other RNA
ttcagtccttgtgtagtcctgttttagagctagaaatagcaagttaaaataaggctagtccgttatcaacttgaaaaagtggcaccgagtcggtgc

SEQ ID NO: 996 - RNA, 96 nt, synthetic construct
  misc_feature 1..96: note = Synthetic
  source 1..96: mol_type = other RNA
tcagtccttgtgtagtcctagttttagagctagaaatagcaagttaaaataaggctagtccgttatcaacttgaaaaagtggcaccgagtcggtgc

SEQ ID NO: 997 - RNA, 96 nt, synthetic construct
  misc_feature 1..96: note = Synthetic
  source 1..96: mol_type = other RNA
gtccttgtgtagtcctaggggttttagagctagaaatagcaagttaaaataaggctagtccgttatcaacttgaaaaagtggcaccgagtcggtgc

SEQ ID NO: 998 - RNA, 96 nt, synthetic construct
  misc_feature 1..96: note = Synthetic
  source 1..96: mol_type = other RNA
cttgtgtagtcctagggagggttttagagctagaaatagcaagttaaaataaggctagtccgttatcaacttgaaaaagtggcaccgagtcggtgc

SEQ ID NO: 999 - RNA, 96 nt, synthetic construct
  misc_feature 1..96: note = Synthetic
  source 1..96: mol_type = other RNA
ctcctccctaggactacacagttttagagctagaaatagcaagttaaaataaggctagtccgttatcaacttgaaaaagtggcaccgagtcggtgc

SEQ ID NO: 1000 - RNA, 96 nt, synthetic construct
  misc_feature 1..96: note = Synthetic
  source 1..96: mol_type = other RNA
gtagacagtacctcctccctgttttagagctagaaatagcaagttaaaataaggctagtccgttatcaacttgaaaaagtggcaccgagtcggtgc

SEQ ID NO: 1001 - RNA, 96 nt, synthetic construct
  misc_feature 1..96: note = Synthetic
  source 1..96: mol_type = other RNA
tactgtctacacagagctctgttttagagctagaaatagcaagttaaaataaggctagtccgttatcaacttgaaaaagtggcaccgagtcggtgc

SEQ ID NO: 1002 - RNA, 96 nt, synthetic construct
  misc_feature 1..96: note = Synthetic
  source 1..96: mol_type = other RNA
actgtctacacagagctctagttttagagctagaaatagcaagttaaaataaggctagtccgttatcaacttgaaaaagtggcaccgagtcggtgc

SEQ ID NO: 1003 - RNA, 96 nt, synthetic construct
  misc_feature 1..96: note = Synthetic
  source 1..96: mol_type = other RNA
tctacacagagctctagggagttttagagctagaaatagcaagttaaaataaggctagtccgttatcaacttgaaaaagtggcaccgagtcggtgc

SEQ ID NO: 1004 - RNA, 96 nt, synthetic construct
  misc_feature 1..96: note = Synthetic
  source 1..96: mol_type = other RNA
ctacacagagctctagggaagttttagagctagaaatagcaagttaaaataaggctagtccgttatcaacttgaaaaagtggcaccgagtcggtgc

SEQ ID NO: 1005 - RNA, 96 nt, synthetic construct
  misc_feature 1..96: note = Synthetic
  source 1..96: mol_type = other RNA
tacacagagctctagggaaggttttagagctagaaatagcaagttaaaataaggctagtccgttatcaacttgaaaaagtggcaccgagtcggtgc

SEQ ID NO: 1006 - RNA, 96 nt, synthetic construct
  misc_feature 1..96: note = Synthetic
  source 1..96: mol_type = other RNA
ggggtgtgcccagttgttaagttttagagctagaaatagcaagttaaaataaggctagtccgttatcaacttgaaaaagtggcaccgagtcggtgc

SEQ ID NO: 1007 - RNA, 96 nt, synthetic construct
  misc_feature 1..96: note = Synthetic
  source 1..96: mol_type = other RNA
gggtgtgcccagttgttaatgttttagagctagaaatagcaagttaaaataaggctagtccgttatcaacttgaaaaagtggcaccgagtcggtgc

SEQ ID NO: 1008 - RNA, 96 nt, synthetic construct
  misc_feature 1..96: note = Synthetic
  source 1..96: mol_type = other RNA
tggtagtcccattaacaactgttttagagctagaaatagcaagttaaaataaggctagtccgttatcaacttgaaaaagtggcaccgagtcggtgc

SEQ ID NO: 1009 - RNA, 96 nt, synthetic construct
  misc_feature 1..96: note = Synthetic
  source 1..96: mol_type = other RNA
ctggtagtcccattaacaacgttttagagctagaaatagcaagttaaaataaggctagtccgttatcaacttgaaaaagtggcaccgagtcggtgc

SEQ ID NO: 1010 - RNA, 96 nt, synthetic construct
  misc_feature 1..96: note = Synthetic
  source 1..96: mol_type = other RNA
ttgttaatgggactaccagagttttagagctagaaatagcaagttaaaataaggctagtccgttatcaacttgaaaaagtggcaccgagtcggtgc

SEQ ID NO: 1011 - RNA, 96 nt, synthetic construct
  misc_feature 1..96: note = Synthetic
  source 1..96: mol_type = other RNA
taccagatggaagccagcttgttttagagctagaaatagcaagttaaaataaggctagtccgttatcaacttgaaaaagtggcaccgagtcggtgc

SEQ ID NO: 1012 - RNA, 96 nt, synthetic construct
  misc_feature 1..96: note = Synthetic
  source 1..96: mol_type = other RNA
ttccaaagctggcttccatcgttttagagctagaaatagcaagttaaaataaggctagtccgttatcaacttgaaaaagtggcaccgagtcggtgc

SEQ ID NO: 1013 - RNA, 96 nt, synthetic construct
  misc_feature 1..96: note = Synthetic
  source 1..96: mol_type = other RNA
tggaagccagctttggaagcgttttagagctagaaatagcaagttaaaataaggctagtccgttatcaacttgaaaaagtggcaccgagtcggtgc

SEQ ID NO: 1014 - RNA, 96 nt, synthetic construct
  misc_feature 1..96: note = Synthetic
  source 1..96: mol_type = other RNA
acaaggcctgcttccaaagcgttttagagctagaaatagcaagttaaaataaggctagtccgttatcaacttgaaaaagtggcaccgagtcggtgc

SEQ ID NO: 1015 - RNA, 96 nt, synthetic construct
  misc_feature 1..96: note = Synthetic
  source 1..96: mol_type = other RNA
gccttgttcacgtgttctaagttttagagctagaaatagcaagttaaaataaggctagtccgttatcaacttgaaaaagtggcaccgagtcggtgc

SEQ ID NO: 1016 - RNA, 96 nt, synthetic construct
  misc_feature 1..96: note = Synthetic
  source 1..96: mol_type = other RNA
ccttgttcacgtgttctaatgttttagagctagaaatagcaagttaaaataaggctagtccgttatcaacttgaaaaagtggcaccgagtcggtgc

SEQ ID NO: 1017 - RNA, 96 nt, synthetic construct
  misc_feature 1..96: note = Synthetic
  source 1..96: mol_type = other RNA
cccattagaacacgtgaacagttttagagctagaaatagcaagttaaaataaggctagtccgttatcaacttgaaaaagtggcaccgagtcggtgc

SEQ ID NO: 1018 - RNA, 96 nt, synthetic construct
  misc_feature 1..96: note = Synthetic
  source 1..96: mol_type = other RNA
ttggcatcacttcatatttggttttagagctagaaatagcaagttaaaataaggctagtccgttatcaacttgaaaaagtggcaccgagtcggtgc

SEQ ID NO: 1019 - RNA, 96 nt, synthetic construct
  misc_feature 1..96: note = Synthetic
  source 1..96: mol_type = other RNA
cttgtgctcttggcatcactgttttagagctagaaatagcaagttaaaataaggctagtccgttatcaacttgaaaaagtggcaccgagtcggtgc

SEQ ID NO: 1020 - RNA, 96 nt, synthetic construct
  misc_feature 1..96: note = Synthetic
  source 1..96: mol_type = other RNA
agcacactctcttgtgctctgttttagagctagaaatagcaagttaaaataaggctagtccgttatcaacttgaaaaagtggcaccgagtcggtgc

SEQ ID NO: 1021 - RNA, 96 nt, synthetic construct
  misc_feature 1..96: note = Synthetic
  source 1..96: mol_type = other RNA
gcacaagagagtgtgctctcgttttagagctagaaatagcaagttaaaataaggctagtccgttatcaacttgaaaaagtggcaccgagtcggtgc

SEQ ID NO: 1022 - RNA, 96 nt, synthetic construct
  misc_feature 1..96: note = Synthetic
  source 1..96: mol_type = other RNA
gcttaatctcacacatagaagttttagagctagaaatagcaagttaaaataaggctagtccgttatcaacttgaaaaagtggcaccgagtcggtgc

SEQ ID NO: 1023 - RNA, 96 nt, synthetic construct
  misc_feature 1..96: note = Synthetic
  source 1..96: mol_type = other RNA
cttaatctcacacatagaaagttttagagctagaaatagcaagttaaaataaggctagtccgttatcaacttgaaaaagtggcaccgagtcggtgc

SEQ ID NO: 1024 - RNA, 96 nt, synthetic construct
  misc_feature 1..96: note = Synthetic
  source 1..96: mol_type = other RNA
ttaatctcacacatagaaaggttttagagctagaaatagcaagttaaaataaggctagtccgttatcaacttgaaaaagtggcaccgagtcggtgc

SEQ ID NO: 1025 - RNA, 96 nt, synthetic construct
  misc_feature 1..96: note = Synthetic
  source 1..96: mol_type = other RNA
aggagtgctggtttatcaacgttttagagctagaaatagcaagttaaaataaggctagtccgttatcaacttgaaaaagtggcaccgagtcggtgc

SEQ ID NO: 1026 - RNA, 96 nt, synthetic construct
  misc_feature 1..96: note = Synthetic
  source 1..96: mol_type = other RNA
ttctttgacagcaggagtgcgttttagagctagaaatagcaagttaaaataaggctagtccgttatcaacttgaaaaagtggcaccgagtcggtgc

SEQ ID NO: 1027 - RNA, 96 nt, synthetic construct
  misc_feature 1..96: note = Synthetic
  source 1..96: mol_type = other RNA
actctggtttctttgacagcgttttagagctagaaatagcaagttaaaataaggctagtccgttatcaacttgaaaaagtggcaccgagtcggtgc

SEQ ID NO: 1028 - RNA, 96 nt, synthetic construct
  misc_feature 1..96: note = Synthetic
  source 1..96: mol_type = other RNA
accagagttgagaaaaccccgttttagagctagaaatagcaagttaaaataaggctagtccgttatcaacttgaaaaagtggcaccgagtcggtgc

SEQ ID NO: 1029 - RNA, 96 nt, synthetic construct
  misc_feature 1..96: note = Synthetic
  source 1..96: mol_type = other RNA
tccaggggttttctcaactcgttttagagctagaaatagcaagttaaaataaggctagtccgttatcaacttgaaaaagtggcaccgagtcggtgc

SEQ ID NO: 1030 - RNA, 96 nt, synthetic construct
  misc_feature 1..96: note = Synthetic
  source 1..96: mol_type = other RNA
cagttattaaatgaatccaggttttagagctagaaatagcaagttaaaataaggctagtccgttatcaacttgaaaaagtggcaccgagtcggtgc

SEQ ID NO: 1031 - RNA, 96 nt, synthetic construct
  misc_feature 1..96: note = Synthetic
  source 1..96: mol_type = other RNA
gcagttattaaatgaatccagttttagagctagaaatagcaagttaaaataaggctagtccgttatcaacttgaaaaagtggcaccgagtcggtgc

SEQ ID NO: 1032 - RNA, 96 nt, synthetic construct
  misc_feature 1..96: note = Synthetic
  source 1..96: mol_type = other RNA
ggcagttattaaatgaatccgttttagagctagaaatagcaagttaaaataaggctagtccgttatcaacttgaaaaagtggcaccgagtcggtgc

SEQ ID NO: 1033 - RNA, 96 nt, synthetic construct
  misc_feature 1..96: note = Synthetic
  source 1..96: mol_type = other RNA
tggatggtaacagctacatcgttttagagctagaaatagcaagttaaaataaggctagtccgttatcaacttgaaaaagtggcaccgagtcggtgc

SEQ ID NO: 1034 - RNA, 96 nt, synthetic construct
  misc_feature 1..96: note = Synthetic
  source 1..96: mol_type = other RNA
gctgttaccatccacatcctgttttagagctagaaatagcaagttaaaataaggctagtccgttatcaacttgaaaaagtggcaccgagtcggtgc

SEQ ID NO: 1035 - RNA, 96 nt, synthetic construct
  misc_feature 1..96: note = Synthetic
  source 1..96: mol_type = other RNA
tcaagaaccaaggatgtggagttttagagctagaaatagcaagttaaaataaggctagtccgttatcaacttgaaaaagtggcaccgagtcggtgc

SEQ ID NO: 1036 - RNA, 96 nt, synthetic construct
  misc_feature 1..96: note = Synthetic
  source 1..96: mol_type = other RNA
tccttcaagaaccaaggatggttttagagctagaaatagcaagttaaaataaggctagtccgttatcaacttgaaaaagtggcaccgagtcggtgc

SEQ ID NO: 1037 - RNA, 96 nt, synthetic construct
  misc_feature 1..96: note = Synthetic
  source 1..96: mol_type = other RNA
tgagtgtccttcaagaaccagttttagagctagaaatagcaagttaaaataaggctagtccgttatcaacttgaaaaagtggcaccgagtcggtgc

SEQ ID NO: 1038 - RNA, 96 nt, synthetic construct
  misc_feature 1..96: note = Synthetic
  source 1..96: mol_type = other RNA
ttttattttataactacaaggttttagagctagaaatagcaagttaaaataaggctagtccgttatcaacttgaaaaagtggcaccgagtcggtgc

SEQ ID NO: 1039 - RNA, 96 nt, synthetic construct
  misc_feature 1..96: note = Synthetic
  source 1..96: mol_type = other RNA
ttgtttttaataaaaacaaggttttagagctagaaatagcaagttaaaataaggctagtccgttatcaacttgaaaaagtggcaccgagtcggtgc

SEQ ID NO: 1040 - RNA, 96 nt, synthetic construct
  misc_feature 1..96: note = Synthetic
  source 1..96: mol_type = other RNA
tattatagaatgcttttgcagttttagagctagaaatagcaagttaaaataaggctagtccgttatcaacttgaaaaagtggcaccgagtcggtgc

SEQ ID NO: 1041 - RNA, 96 nt, synthetic construct
  misc_feature 1..96: note = Synthetic
  source 1..96: mol_type = other RNA
caagattagtcttgatgtaggttttagagctagaaatagcaagttaaaataaggctagtccgttatcaacttgaaaaagtggcaccgagtcggtgc

SEQ ID NO: 1042 - RNA, 96 nt, synthetic construct
  misc_feature 1..96: note = Synthetic
  source 1..96: mol_type = other RNA
aagattagtcttgatgtagtgttttagagctagaaatagcaagttaaaataaggctagtccgttatcaacttgaaaaagtggcaccgagtcggtgc

SEQ ID NO: 1043 - RNA, 96 nt, synthetic construct
  misc_feature 1..96: note = Synthetic
  source 1..96: mol_type = other RNA
agtcttgatgtagtgggagtgttttagagctagaaatagcaagttaaaataaggctagtccgttatcaacttgaaaaagtggcaccgagtcggtgc

SEQ ID NO: 1044 - RNA, 96 nt, synthetic construct
  misc_feature 1..96: note = Synthetic
  source 1..96: mol_type = other RNA
tttttctattaaaaaaaaaagttttagagctagaaatagcaagttaaaataaggctagtccgttatcaacttgaaaaagtggcaccgagtcggtgc

SEQ ID NO: 1045 - RNA, 96 nt, synthetic construct
  misc_feature 1..96: note = Synthetic
  source 1..96: mol_type = other RNA
tctattaaaaaaaaaaaggcgttttagagctagaaatagcaagttaaaataaggctagtccgttatcaacttgaaaaagtggcaccgagtcggtgc

SEQ ID NO: 1046 - RNA, 96 nt, synthetic construct
  misc_feature 1..96: note = Synthetic
  source 1..96: mol_type = other RNA
ctattaaaaaaaaaaaggctgttttagagctagaaatagcaagttaaaataaggctagtccgttatcaacttgaaaaagtggcaccgagtcggtgc

SEQ ID NO: 1047 - RNA, 96 nt, synthetic construct
  misc_feature 1..96: note = Synthetic
  source 1..96: mol_type = other RNA
aaaaaaaaaaaggctgggcagttttagagctagaaatagcaagttaaaataaggctagtccgttatcaacttgaaaaagtggcaccgagtcggtgc

SEQ ID NO: 1048 - RNA, 96 nt, synthetic construct
  misc_feature 1..96: note = Synthetic
  source 1..96: mol_type = other RNA
aaaaaaaaggctgggcacgggttttagagctagaaatagcaagttaaaataaggctagtccgttatcaacttgaaaaagtggcaccgagtcggtgc

SEQ ID NO: 1049 - RNA, 96 nt, synthetic construct
  misc_feature 1..96: note = Synthetic
  source 1..96: mol_type = other RNA
cacccgtaatcccagcacttgttttagagctagaaatagcaagttaaaataaggctagtccgttatcaacttgaaaaagtggcaccgagtcggtgc

SEQ ID NO: 1050 - RNA, 96 nt, synthetic construct
  misc_feature 1..96: note = Synthetic
  source 1..96: mol_type = other RNA
acccgtaatcccagcactttgttttagagctagaaatagcaagttaaaataaggctagtccgttatcaacttgaaaaagtggcaccgagtcggtgc

SEQ ID NO: 1051 - RNA, 96 nt, synthetic construct
  misc_feature 1..96: note = Synthetic
  source 1..96: mol_type = other RNA
cgtaatcccagcactttggggttttagagctagaaatagcaagttaaaataaggctagtccgttatcaacttgaaaaagtggcaccgagtcggtgc

SEQ ID NO: 1052 - RNA, 96 nt, synthetic construct
  misc_feature 1..96: note = Synthetic
  source 1..96: mol_type = other RNA
tcccaaagtgctgggattacgttttagagctagaaatagcaagttaaaataaggctagtccgttatcaacttgaaaaagtggcaccgagtcggtgc

SEQ ID NO: 1053 - RNA, 96 nt, synthetic construct
  misc_feature 1..96: note = Synthetic
  source 1..96: mol_type = other RNA
ctcccaaagtgctgggattagttttagagctagaaatagcaagttaaaataaggctagtccgttatcaacttgaaaaagtggcaccgagtcggtgc

SEQ ID NO: 1054 - RNA, 96 nt, synthetic construct
  misc_feature 1..96: note = Synthetic
  source 1..96: mol_type = other RNA
cccagcactttgggaggccggttttagagctagaaatagcaagttaaaataaggctagtccgttatcaacttgaaaaagtggcaccgagtcggtgc

SEQ ID NO: 1055 - RNA, 96 nt, synthetic construct
  misc_feature 1..96: note = Synthetic
  source 1..96: mol_type = other RNA
cctcggcctcccaaagtgctgttttagagctagaaatagcaagttaaaataaggctagtccgttatcaacttgaaaaagtggcaccgagtcggtgc

SEQ ID NO: 1056 - RNA, 96 nt, synthetic construct
  misc_feature 1..96: note = Synthetic
  source 1..96: mol_type = other RNA
gcactttgggaggccgaggcgttttagagctagaaatagcaagttaaaataaggctagtccgttatcaacttgaaaaagtggcaccgagtcggtgc

SEQ ID NO: 1057 - RNA, 96 nt, synthetic construct
  misc_feature 1..96: note = Synthetic
  source 1..96: mol_type = other RNA
ctttgggaggccgaggcagggttttagagctagaaatagcaagttaaaataaggctagtccgttatcaacttgaaaaagtggcaccgagtcggtgc

SEQ ID NO: 1058 - RNA, 96 nt, synthetic construct
  misc_feature 1..96: note = Synthetic
  source 1..96: mol_type = other RNA
gccgaggcaggtggatcacggttttagagctagaaatagcaagttaaaataaggctagtccgttatcaacttgaaaaagtggcaccgagtcggtgc

SEQ ID NO: 1059 - RNA, 96 nt, synthetic construct
  misc_feature 1..96: note = Synthetic
  source 1..96: mol_type = other RNA
acctcgtgatccacctgcctgttttagagctagaaatagcaagttaaaataaggctagtccgttatcaacttgaaaaagtggcaccgagtcggtgc

SEQ ID NO: 1060 - RNA, 96 nt, synthetic construct
  misc_feature 1..96: note = Synthetic
  source 1..96: mol_type = other RNA
ggcaggtggatcacgaggtcgttttagagctagaaatagcaagttaaaataaggctagtccgttatcaacttgaaaaagtggcaccgagtcggtgc

SEQ ID NO: 1061 - RNA, 96 nt, synthetic construct
  misc_feature 1..96: note = Synthetic
  source 1..96: mol_type = other RNA
tcaggagatcgagaccatctgttttagagctagaaatagcaagttaaaataaggctagtccgttatcaacttgaaaaagtggcaccgagtcggtgc

SEQ ID NO: 1062 - RNA, 96 nt, synthetic construct
  misc_feature 1..96: note = Synthetic
  source 1..96: mol_type = other RNA
cgagaccatcttggctaacagttttagagctagaaatagcaagttaaaataaggctagtccgttatcaacttgaaaaagtggcaccgagtcggtgc

SEQ ID NO: 1063 - RNA, 96 nt, synthetic construct
  misc_feature 1..96: note = Synthetic
  source 1..96: mol_type = other RNA
tttcaccatgttagccaagagttttagagctagaaatagcaagttaaaataaggctagtccgttatcaacttgaaaaagtggcaccgagtcggtgc

SEQ ID NO: 1064 - RNA, 96 nt, synthetic construct
  misc_feature 1..96: note = Synthetic
  source 1..96: mol_type = other RNA
ttgtattttttgtagagacggttttagagctagaaatagcaagttaaaataaggctagtccgttatcaacttgaaaaagtggcaccgagtcggtgc

SEQ ID NO: 1065 - RNA, 96 nt, synthetic construct
  misc_feature 1..96: note = Synthetic
  source 1..96: mol_type = other RNA
tttgtattttttgtagagacgttttagagctagaaatagcaagttaaaataaggctagtccgttatcaacttgaaaaagtggcaccgagtcggtgc

SEQ ID NO: 1066 - RNA, 96 nt, synthetic construct
  misc_feature 1..96: note = Synthetic
  source 1..96: mol_type = other RNA
ttttgtattttttgtagagagttttagagctagaaatagcaagttaaaataaggctagtccgttatcaacttgaaaaagtggcaccgagtcggtgc

SEQ ID NO: 1067 - RNA, 96 nt, synthetic construct
  misc_feature 1..96: note = Synthetic
  source 1..96: mol_type = other RNA
aaaaaatacaaaaaattagcgttttagagctagaaatagcaagttaaaataaggctagtccgttatcaacttgaaaaagtggcaccgagtcggtgc

SEQ ID NO: 1068 - RNA, 96 nt, synthetic construct
  misc_feature 1..96: note = Synthetic
  source 1..96: mol_type = other RNA
aaaaatacaaaaaattagccgttttagagctagaaatagcaagttaaaataaggctagtccgttatcaacttgaaaaagtggcaccgagtcggtgc

SEQ ID NO: 1069 - RNA, 96 nt, synthetic construct
  misc_feature 1..96: note = Synthetic
  source 1..96: mol_type = other RNA
tacaaaaaattagccgggtggttttagagctagaaatagcaagttaaaataaggctagtccgttatcaacttgaaaaagtggcaccgagtcggtgc

SEQ ID NO: 1070 - RNA, 96 nt, synthetic construct
  misc_feature 1..96: note = Synthetic
  source 1..96: mol_type = other RNA
aaaaaattagccgggtgtgggttttagagctagaaatagcaagttaaaataaggctagtccgttatcaacttgaaaaagtggcaccgagtcggtgc

SEQ ID NO: 1071 - RNA, 96 nt, synthetic construct
  misc_feature 1..96: note = Synthetic
  source 1..96: mol_type = other RNA
aaattagccgggtgtggtgggttttagagctagaaatagcaagttaaaataaggctagtccgttatcaacttgaaaaagtggcaccgagtcggtgc

SEQ ID NO: 1072 - RNA, 96 nt, synthetic construct
  misc_feature 1..96: note = Synthetic
  source 1..96: mol_type = other RNA
aattagccgggtgtggtggcgttttagagctagaaatagcaagttaaaataaggctagtccgttatcaacttgaaaaagtggcaccgagtcggtgc

SEQ ID NO: 1073 - RNA, 96 nt, synthetic construct
  misc_feature 1..96: note = Synthetic
  source 1..96: mol_type = other RNA
caggcgcccgccaccacaccgttttagagctagaaatagcaagttaaaataaggctagtccgttatcaacttgaaaaagtggcaccgagtcggtgc

SEQ ID NO: 1074 - RNA, 96 nt, synthetic construct
  misc_feature 1..96: note = Synthetic
  source 1..96: mol_type = other RNA
gcctgtagtcccagctactcgttttagagctagaaatagcaagttaaaataaggctagtccgttatcaacttgaaaaagtggcaccgagtcggtgc

SEQ ID NO: 1075 - RNA, 96 nt, synthetic construct
  misc_feature 1..96: note = Synthetic
  source 1..96: mol_type = other RNA
tgtagtcccagctactcagggttttagagctagaaatagcaagttaaaataaggctagtccgttatcaacttgaaaaagtggcaccgagtcggtgc

SEQ ID NO: 1076 - RNA, 96 nt, synthetic construct
  misc_feature 1..96: note = Synthetic
  source 1..96: mol_type = other RNA
tcctgagtagctgggactacgttttagagctagaaatagcaagttaaaataaggctagtccgttatcaacttgaaaaagtggcaccgagtcggtgc

SEQ ID NO: 1077 - RNA, 96 nt, synthetic construct
  misc_feature 1..96: note = Synthetic
  source 1..96: mol_type = other RNA
cccagctactcaggaggctggttttagagctagaaatagcaagttaaaataaggctagtccgttatcaacttgaaaaagtggcaccgagtcggtgc

SEQ ID NO: 1078 - RNA, 96 nt, synthetic construct
  misc_feature 1..96: note = Synthetic
  source 1..96: mol_type = other RNA
cctcagcctcctgagtagctgttttagagctagaaatagcaagttaaaataaggctagtccgttatcaacttgaaaaagtggcaccgagtcggtgc

SEQ ID NO: 1079 - RNA, 96 nt, synthetic construct
  misc_feature 1..96: note = Synthetic
  source 1..96: mol_type = other RNA
gcctcagcctcctgagtagcgttttagagctagaaatagcaagttaaaataaggctagtccgttatcaacttgaaaaagtggcaccgagtcggtgc

SEQ ID NO: 1080 - RNA, 96 nt, synthetic construct
  misc_feature 1..96: note = Synthetic
  source 1..96: mol_type = other RNA
aggaggctgaggcaggagaagttttagagctagaaatagcaagttaaaataaggctagtccgttatcaacttgaaaaagtggcaccgagtcggtgc

SEQ ID NO: 1081 - RNA, 96 nt, synthetic construct
  misc_feature 1..96: note = Synthetic
  source 1..96: mol_type = other RNA
gcaggagaatggcgtgaaccgttttagagctagaaatagcaagttaaaataaggctagtccgttatcaacttgaaaaagtggcaccgagtcggtgc

SEQ ID NO: 1082 - RNA, 96 nt, synthetic construct
  misc_feature 1..96: note = Synthetic
  source 1..96: mol_type = other RNA
caggagaatggcgtgaacccgttttagagctagaaatagcaagttaaaataaggctagtccgttatcaacttgaaaaagtggcaccgagtcggtgc

SEQ ID NO: 1083 - RNA, 96 nt, synthetic construct
  misc_feature 1..96: note = Synthetic
  source 1..96: mol_type = other RNA
gagaatggcgtgaacccggggttttagagctagaaatagcaagttaaaataaggctagtccgttatcaacttgaaaaagtggcaccgagtcggtgc

SEQ ID NO: 1084 - RNA, 96 nt, synthetic construct
  misc_feature 1..96: note = Synthetic
  source 1..96: mol_type = other RNA
aatggcgtgaacccgggagggttttagagctagaaatagcaagttaaaataaggctagtccgttatcaacttgaaaaagtggcaccgagtcggtgc

SEQ ID NO: 1085 - RNA, 96 nt, synthetic construct
  misc_feature 1..96: note = Synthetic
  source 1..96: mol_type = other RNA
cactgcaagctccacctcccgttttagagctagaaatagcaagttaaaataaggctagtccgttatcaacttgaaaaagtggcaccgagtcggtgc

SEQ ID NO: 1086 - RNA, 96 nt, synthetic construct
  misc_feature 1..96: note = Synthetic
  source 1..96: mol_type = other RNA
tcactgcaagctccacctccgttttagagctagaaatagcaagttaaaataaggctagtccgttatcaacttgaaaaagtggcaccgagtcggtgc

SEQ ID NO: 1087 - RNA, 96 nt, synthetic construct
  misc_feature 1..96: note = Synthetic
  source 1..96: mol_type = other RNA
cataccactgcactccagccgttttagagctagaaatagcaagttaaaataaggctagtccgttatcaacttgaaaaagtggcaccgagtcggtgc

SEQ ID NO: 1088 - RNA, 96 nt, synthetic construct
  misc_feature 1..96: note = Synthetic
  source 1..96: mol_type = other RNA
ataccactgcactccagcctgttttagagctagaaatagcaagttaaaataaggctagtccgttatcaacttgaaaaagtggcaccgagtcggtgc

SEQ ID NO: 1089 - RNA, 96 nt, synthetic construct
  misc_feature 1..96: note = Synthetic
  source 1..96: mol_type = other RNA
tcgcccaggctggagtgcaggttttagagctagaaatagcaagttaaaataaggctagtccgttatcaacttgaaaaagtggcaccgagtcggtgc

SEQ ID NO: 1090 - RNA, 96 nt, synthetic construct
  misc_feature 1..96: note = Synthetic
  source 1..96: mol_type = other RNA
tctcactctttcgcccaggcgttttagagctagaaatagcaagttaaaataaggctagtccgttatcaacttgaaaaagtggcaccgagtcggtgc

SEQ ID NO: 1091 - RNA, 96 nt, synthetic construct
  misc_feature 1..96: note = Synthetic
  source 1..96: mol_type = other RNA
ggagtctcactctttcgcccgttttagagctagaaatagcaagttaaaataaggctagtccgttatcaacttgaaaaagtggcaccgagtcggtgc

SEQ ID NO: 1092 - RNA, 96 nt, synthetic construct
  misc_feature 1..96: note = Synthetic
  source 1..96: mol_type = other RNA
tgttttttgtttttttgagagttttagagctagaaatagcaagttaaaataaggctagtccgttatcaacttgaaaaagtggcaccgagtcggtgc

SEQ ID NO: 1093 - RNA, 96 nt, synthetic construct
  misc_feature 1..96: note = Synthetic
  source 1..96: mol_type = other RNA
aggaagaaagaaaggtttttgttttagagctagaaatagcaagttaaaataaggctagtccgttatcaacttgaaaaagtggcaccgagtcggtgc

SEQ ID NO: 1094 - RNA, 96 nt, synthetic construct
  misc_feature 1..96: note = Synthetic
  source 1..96: mol_type = other RNA
agaagaaaaggaagaaagaagttttagagctagaaatagcaagttaaaataaggctagtccgttatcaacttgaaaaagtggcaccgagtcggtgc

SEQ ID NO: 1095 - RNA, 96 nt, synthetic construct
  misc_feature 1..96: note = Synthetic
  source 1..96: mol_type = other RNA
ctttcttccttttcttctctgttttagagctagaaatagcaagttaaaataaggctagtccgttatcaacttgaaaaagtggcaccgagtcggtgc

SEQ ID NO: 1096 - RNA, 96 nt, synthetic construct
  misc_feature 1..96: note = Synthetic
  source 1..96: mol_type = other RNA
tttcttccttttcttctcttgttttagagctagaaatagcaagttaaaataaggctagtccgttatcaacttgaaaaagtggcaccgagtcggtgc

SEQ ID NO: 1097 - RNA, 96 nt, synthetic construct
  misc_feature 1..96: note = Synthetic
  source 1..96: mol_type = other RNA
aatggacccaagagaagaaagttttagagctagaaatagcaagttaaaataaggctagtccgttatcaacttgaaaaagtggcaccgagtcggtgc

SEQ ID NO: 1098 - RNA, 96 nt, synthetic construct
  misc_feature 1..96: note = Synthetic
  source 1..96: mol_type = other RNA
ggctattacataagaaacaagttttagagctagaaatagcaagttaaaataaggctagtccgttatcaacttgaaaaagtggcaccgagtcggtgc

SEQ ID NO: 1099 - RNA, 96 nt, synthetic construct
  misc_feature 1..96: note = Synthetic
  source 1..96: mol_type = other RNA
cacaggaaaaggaactgtacgttttagagctagaaatagcaagttaaaataaggctagtccgttatcaacttgaaaaagtggcaccgagtcggtgc

SEQ ID NO: 1100 - RNA, 96 nt, synthetic construct
  misc_feature 1..96: note = Synthetic
  source 1..96: mol_type = other RNA
attaaagctaacacaggaaagttttagagctagaaatagcaagttaaaataaggctagtccgttatcaacttgaaaaagtggcaccgagtcggtgc

SEQ ID NO: 1101 - RNA, 96 nt, synthetic construct
  misc_feature 1..96: note = Synthetic
  source 1..96: mol_type = other RNA
tcaaaaattaaagctaacacgttttagagctagaaatagcaagttaaaataaggctagtccgttatcaacttgaaaaagtggcaccgagtcggtgc

SEQ ID NO: 1102 - RNA, 96 nt, synthetic construct
  misc_feature 1..96: note = Synthetic
  source 1..96: mol_type = other RNA
taaaattgtctaaacatctcgttttagagctagaaatagcaagttaaaataaggctagtccgttatcaacttgaaaaagtggcaccgagtcggtgc

SEQ ID NO: 1103 - RNA, 96 nt, synthetic construct
  misc_feature 1..96: note = Synthetic
  source 1..96: mol_type = other RNA
agagatgtttagacaattttgttttagagctagaaatagcaagttaaaataaggctagtccgttatcaacttgaaaaagtggcaccgagtcggtgc

SEQ ID NO: 1104 - RNA, 96 nt, synthetic construct
  misc_feature 1..96: note = Synthetic
  source 1..96: mol_type = other RNA
tctaaacatctctgggaccagttttagagctagaaatagcaagttaaaataaggctagtccgttatcaacttgaaaaagtggcaccgagtcggtgc

SEQ ID NO: 1105 - RNA, 96 nt, synthetic construct
  misc_feature 1..96: note = Synthetic
  source 1..96: mol_type = other RNA
tttatgctttcatatatcctgttttagagctagaaatagcaagttaaaataaggctagtccgttatcaacttgaaaaagtggcaccgagtcggtgc

SEQ ID NO: 1106 - RNA, 96 nt, synthetic construct
  misc_feature 1..96: note = Synthetic
  source 1..96: mol_type = other RNA
agcataaattacaaagaaaagttttagagctagaaatagcaagttaaaataaggctagtccgttatcaacttgaaaaagtggcaccgagtcggtgc

SEQ ID NO: 1107 - RNA, 96 nt, synthetic construct
  misc_feature 1..96: note = Synthetic
  source 1..96: mol_type = other RNA
tacaaagaaaaaggttatcagttttagagctagaaatagcaagttaaaataaggctagtccgttatcaacttgaaaaagtggcaccgagtcggtgc

SEQ ID NO: 1108 - RNA, 96 nt, synthetic construct
  misc_feature 1..96: note = Synthetic
  source 1..96: mol_type = other RNA
acaaagaaaaaggttatcatgttttagagctagaaatagcaagttaaaataaggctagtccgttatcaacttgaaaaagtggcaccgagtcggtgc

SEQ ID NO: 1109 - RNA, 96 nt, synthetic construct
  misc_feature 1..96: note = Synthetic
  source 1..96: mol_type = other RNA
caaagaaaaaggttatcatggttttagagctagaaatagcaagttaaaataaggctagtccgttatcaacttgaaaaagtggcaccgagtcggtgc

SEQ ID NO: 1110 - RNA, 96 nt, synthetic construct
  misc_feature 1..96: note = Synthetic
  source 1..96: mol_type = other RNA
tctgagatttaaaatagagtgttttagagctagaaatagcaagttaaaataaggctagtccgttatcaacttgaaaaagtggcaccgagtcggtgc

SEQ ID NO: 1111 - RNA, 96 nt, synthetic construct
  misc_feature 1..96: note = Synthetic
  source 1..96: mol_type = other RNA
cttataagatacattatgaagttttagagctagaaatagcaagttaaaataaggctagtccgttatcaacttgaaaaagtggcaccgagtcggtgc

SEQ ID NO: 1112 - RNA, 96 nt, synthetic construct
  misc_feature 1..96: note = Synthetic
  source 1..96: mol_type = other RNA
tatcttataagactataaaagttttagagctagaaatagcaagttaaaataaggctagtccgttatcaacttgaaaaagtggcaccgagtcggtgc

SEQ ID NO: 1113 - RNA, 96 nt, synthetic construct
  misc_feature 1..96: note = Synthetic
  source 1..96: mol_type = other RNA
atcttataagactataaaaagttttagagctagaaatagcaagttaaaataaggctagtccgttatcaacttgaaaaagtggcaccgagtcggtgc

SEQ ID NO: 1114 - RNA, 96 nt, synthetic construct
  misc_feature 1..96: note = Synthetic
  source 1..96: mol_type = other RNA
ttataagactataaaaaggggttttagagctagaaatagcaagttaaaataaggctagtccgttatcaacttgaaaaagtggcaccgagtcggtgc

SEQ ID NO: 1115 - RNA, 96 nt, synthetic construct
  misc_feature 1..96: note = Synthetic
  source 1..96: mol_type = other RNA
taaaaagggaggaaatataggttttagagctagaaatagcaagttaaaataaggctagtccgttatcaacttgaaaaagtggcaccgagtcggtgc

SEQ ID NO: 1116 - RNA, 96 nt, synthetic construct
  misc_feature 1..96: note = Synthetic
  source 1..96: mol_type = other RNA
aaaaagggaggaaatatagagttttagagctagaaatagcaagttaaaataaggctagtccgttatcaacttgaaaaagtggcaccgagtcggtgc

SEQ ID NO: 1117 - RNA, 96 nt, synthetic construct
  misc_feature 1..96: note = Synthetic
  source 1..96: mol_type = other RNA
aaatatagagggtccactttgttttagagctagaaatagcaagttaaaataaggctagtccgttatcaacttgaaaaagtggcaccgagtcggtgc

SEQ ID NO: 1118 - RNA, 96 nt, synthetic construct
  misc_feature 1..96: note = Synthetic
  source 1..96: mol_type = other RNA
tatagagggtccacttttgggttttagagctagaaatagcaagttaaaataaggctagtccgttatcaacttgaaaaagtggcaccgagtcggtgc

SEQ ID NO: 1119 - RNA, 96 nt, synthetic construct
  misc_feature 1..96: note = Synthetic
  source 1..96: mol_type = other RNA
actctgaagtccaccaaaaggttttagagctagaaatagcaagttaaaataaggctagtccgttatcaacttgaaaaagtggcaccgagtcggtgc

SEQ ID NO: 1120 - RNA, 96 nt, synthetic construct
  misc_feature 1..96: note = Synthetic
  source 1..96: mol_type = other RNA
agaatagagttgcaccgtttgttttagagctagaaatagcaagttaaaataaggctagtccgttatcaacttgaaaaagtggcaccgagtcggtgc

SEQ ID NO: 1121 - RNA, 96 nt, synthetic construct
  misc_feature 1..96: note = Synthetic
  source 1..96: mol_type = other RNA
aaaacggtgcaactctattcgttttagagctagaaatagcaagttaaaataaggctagtccgttatcaacttgaaaaagtggcaccgagtcggtgc

SEQ ID NO: 1122 - RNA, 96 nt, synthetic construct
  misc_feature 1..96: note = Synthetic
  source 1..96: mol_type = other RNA
ccgttttgggctaatgaaaagttttagagctagaaatagcaagttaaaataaggctagtccgttatcaacttgaaaaagtggcaccgagtcggtgc

SEQ ID NO: 1123 - RNA, 96 nt, synthetic construct
  misc_feature 1..96: note = Synthetic
  source 1..96: mol_type = other RNA
cctttttcattagcccaaaagttttagagctagaaatagcaagttaaaataaggctagtccgttatcaacttgaaaaagtggcaccgagtcggtgc

SEQ ID NO: 1124 - RNA, 96 nt, synthetic construct
  misc_feature 1..96: note = Synthetic
  source 1..96: mol_type = other RNA
tgggctaatgaaaaaggaaggttttagagctagaaatagcaagttaaaataaggctagtccgttatcaacttgaaaaagtggcaccgagtcggtgc

SEQ ID NO: 1125 - RNA, 96 nt, synthetic construct
  misc_feature 1..96: note = Synthetic
  source 1..96: mol_type = other RNA
taatgaaaaaggaagaggctgttttagagctagaaatagcaagttaaaataaggctagtccgttatcaacttgaaaaagtggcaccgagtcggtgc

SEQ ID NO: 1126 - RNA, 96 nt, synthetic construct
  misc_feature 1..96: note = Synthetic
  source 1..96: mol_type = other RNA
aatgaaaaaggaagaggctagttttagagctagaaatagcaagttaaaataaggctagtccgttatcaacttgaaaaagtggcaccgagtcggtgc

SEQ ID NO: 1127 - RNA, 96 nt, synthetic construct
  misc_feature 1..96: note = Synthetic
  source 1..96: mol_type = other RNA
ctgaatcttaaaatatgtccgttttagagctagaaatagcaagttaaaataaggctagtccgttatcaacttgaaaaagtggcaccgagtcggtgc

SEQ ID NO: 1128 - RNA, 96 nt, synthetic construct
  misc_feature 1..96: note = Synthetic
  source 1..96: mol_type = other RNA
caggcagctttatctcaaccgttttagagctagaaatagcaagttaaaataaggctagtccgttatcaacttgaaaaagtggcaccgagtcggtgc

SEQ ID NO: 1129 - RNA, 96 nt, synthetic construct
  misc_feature 1..96: note = Synthetic
  source 1..96: mol_type = other RNA
ctaagagatcaagtttcagcgttttagagctagaaatagcaagttaaaataaggctagtccgttatcaacttgaaaaagtggcaccgagtcggtgc

SEQ ID NO: 1130 - RNA, 96 nt, synthetic construct
  misc_feature 1..96: note = Synthetic
  source 1..96: mol_type = other RNA
gtgttcttgttgatattctggttttagagctagaaatagcaagttaaaataaggctagtccgttatcaacttgaaaaagtggcaccgagtcggtgc

SEQ ID NO: 1131 - RNA, 96 nt, synthetic construct
  misc_feature 1..96: note = Synthetic
  source 1..96: mol_type = other RNA
cttgttgatattctgtggcagttttagagctagaaatagcaagttaaaataaggctagtccgttatcaacttgaaaaagtggcaccgagtcggtgc

SEQ ID NO: 1132 - RNA, 96 nt, synthetic construct
  misc_feature 1..96: note = Synthetic
  source 1..96: mol_type = other RNA
tctgtggcatggctacagatgttttagagctagaaatagcaagttaaaataaggctagtccgttatcaacttgaaaaagtggcaccgagtcggtgc

SEQ ID NO: 1133 - RNA, 96 nt, synthetic construct
  misc_feature 1..96: note = Synthetic
  source 1..96: mol_type = other RNA
agaacttatttacacagggagttttagagctagaaatagcaagttaaaataaggctagtccgttatcaacttgaaaaagtggcaccgagtcggtgc

SEQ ID NO: 1134 - RNA, 96 nt, synthetic construct
  misc_feature 1..96: note = Synthetic
  source 1..96: mol_type = other RNA
aaagagaacttatttacacagttttagagctagaaatagcaagttaaaataaggctagtccgttatcaacttgaaaaagtggcaccgagtcggtgc

SEQ ID NO: 1135 - RNA, 96 nt, synthetic construct
  misc_feature 1..96: note = Synthetic
  source 1..96: mol_type = other RNA
caaagagaacttatttacacgttttagagctagaaatagcaagttaaaataaggctagtccgttatcaacttgaaaaagtggcaccgagtcggtgc

SEQ ID NO: 1136 - RNA, 96 nt, synthetic construct
  misc_feature 1..96: note = Synthetic
  source 1..96: mol_type = other RNA
ttctctttgtatttacttttgttttagagctagaaatagcaagttaaaataaggctagtccgttatcaacttgaaaaagtggcaccgagtcggtgc

SEQ ID NO: 1137 - RNA, 96 nt, synthetic construct
  misc_feature 1..96: note = Synthetic
  source 1..96: mol_type = other RNA
tctctttgtatttacttttagttttagagctagaaatagcaagttaaaataaggctagtccgttatcaacttgaaaaagtggcaccgagtcggtgc

SEQ ID NO: 1138 - RNA, 96 nt, synthetic construct
  misc_feature 1..96: note = Synthetic
  source 1..96: mol_type = other RNA
ctttgtatttacttttaggggttttagagctagaaatagcaagttaaaataaggctagtccgttatcaacttgaaaaagtggcaccgagtcggtgc

SEQ ID NO: 1139 - RNA, 96 nt, synthetic construct
  misc_feature 1..96: note = Synthetic
  source 1..96: mol_type = other RNA
agcttttgtccacctttaaagttttagagctagaaatagcaagttaaaataaggctagtccgttatcaacttgaaaaagtggcaccgagtcggtgc

SEQ ID NO: 1140 - RNA, 96 nt, synthetic construct
  misc_feature 1..96: note = Synthetic
  source 1..96: mol_type = other RNA
tttatttttccatttaaagggttttagagctagaaatagcaagttaaaataaggctagtccgttatcaacttgaaaaagtggcaccgagtcggtgc

SEQ ID NO: 1141 - RNA, 96 nt, synthetic construct
  misc_feature 1..96: note = Synthetic
  source 1..96: mol_type = other RNA
tattttatttttccatttaagttttagagctagaaatagcaagttaaaataaggctagtccgttatcaacttgaaaaagtggcaccgagtcggtgc

SEQ ID NO: 1142 - RNA, 96 nt, synthetic construct
  misc_feature 1..96: note = Synthetic
  source 1..96: mol_type = other RNA
cttacataaacatacttaaagttttagagctagaaatagcaagttaaaataaggctagtccgttatcaacttgaaaaagtggcaccgagtcggtgc

SEQ ID NO: 1143 - RNA, 96 nt, synthetic construct
  misc_feature 1..96: note = Synthetic
  source 1..96: mol_type = other RNA
taagcacagaagtttttaaggttttagagctagaaatagcaagttaaaataaggctagtccgttatcaacttgaaaaagtggcaccgagtcggtgc

SEQ ID NO: 1144 - RNA, 96 nt, synthetic construct
  misc_feature 1..96: note = Synthetic
  source 1..96: mol_type = other RNA
aagtttttaagaggcatgaagttttagagctagaaatagcaagttaaaataaggctagtccgttatcaacttgaaaaagtggcaccgagtcggtgc

SEQ ID NO: 1145 - RNA, 96 nt, synthetic construct
  misc_feature 1..96: note = Synthetic
  source 1..96: mol_type = other RNA
atatttacgtagtttttcatgttttagagctagaaatagcaagttaaaataaggctagtccgttatcaacttgaaaaagtggcaccgagtcggtgc

SEQ ID NO: 1146 - RNA, 96 nt, synthetic construct
  misc_feature 1..96: note = Synthetic
  source 1..96: mol_type = other RNA
cgtaaatattcttgagaaacgttttagagctagaaatagcaagttaaaataaggctagtccgttatcaacttgaaaaagtggcaccgagtcggtgc

SEQ ID NO: 1147 - RNA, 96 nt, synthetic construct
  misc_feature 1..96: note = Synthetic
  source 1..96: mol_type = other RNA
ttcttgagaaacaggaagacgttttagagctagaaatagcaagttaaaataaggctagtccgttatcaacttgaaaaagtggcaccgagtcggtgc

SEQ ID NO: 1148 - RNA, 96 nt, synthetic construct
  misc_feature 1..96: note = Synthetic
  source 1..96: mol_type = other RNA
taatattaaaaacattggttgttttagagctagaaatagcaagttaaaataaggctagtccgttatcaacttgaaaaagtggcaccgagtcggtgc

SEQ ID NO: 1149 - RNA, 96 nt, synthetic construct
  misc_feature 1..96: note = Synthetic
  source 1..96: mol_type = other RNA
ccaatgtttttaatattatcgttttagagctagaaatagcaagttaaaataaggctagtccgttatcaacttgaaaaagtggcaccgagtcggtgc

SEQ ID NO: 1150 - RNA, 96 nt, synthetic construct
  misc_feature 1..96: note = Synthetic
  source 1..96: mol_type = other RNA
cctgataatattaaaaacatgttttagagctagaaatagcaagttaaaataaggctagtccgttatcaacttgaaaaagtggcaccgagtcggtgc

SEQ ID NO: 1151 - RNA, 96 nt, synthetic construct
  misc_feature 1..96: note = Synthetic
  source 1..96: mol_type = other RNA
cattatcatgcatacatctcgttttagagctagaaatagcaagttaaaataaggctagtccgttatcaacttgaaaaagtggcaccgagtcggtgc

SEQ ID NO: 1152 - RNA, 96 nt, synthetic construct
  misc_feature 1..96: note = Synthetic
  source 1..96: mol_type = other RNA
atcatgcatacatctctggcgttttagagctagaaatagcaagttaaaataaggctagtccgttatcaacttgaaaaagtggcaccgagtcggtgc

SEQ ID NO: 1153 - RNA, 96 nt, synthetic construct
  misc_feature 1..96: note = Synthetic
  source 1..96: mol_type = other RNA
ttcatttcattttgattttggttttagagctagaaatagcaagttaaaataaggctagtccgttatcaacttgaaaaagtggcaccgagtcggtgc

SEQ ID NO: 1154 - RNA, 96 nt, synthetic construct
  misc_feature 1..96: note = Synthetic
  source 1..96: mol_type = other RNA
attcaatttgaagcagtggtgttttagagctagaaatagcaagttaaaataaggctagtccgttatcaacttgaaaaagtggcaccgagtcggtgc

SEQ ID NO: 1155 - RNA, 96 nt, synthetic construct
  misc_feature 1..96: note = Synthetic
  source 1..96: mol_type = other RNA
gaatattcaatttgaagcaggttttagagctagaaatagcaagttaaaataaggctagtccgttatcaacttgaaaaagtggcaccgagtcggtgc

SEQ ID NO: 1156 - RNA, 96 nt, synthetic construct
  misc_feature 1..96: note = Synthetic
  source 1..96: mol_type = other RNA
catacgatttaaaatcgctggttttagagctagaaatagcaagttaaaataaggctagtccgttatcaacttgaaaaagtggcaccgagtcggtgc

SEQ ID NO: 1157 - RNA, 96 nt, synthetic construct
  misc_feature 1..96: note = Synthetic
  source 1..96: mol_type = other RNA
aaaatcgctgaggcgcgttcgttttagagctagaaatagcaagttaaaataaggctagtccgttatcaacttgaaaaagtggcaccgagtcggtgc

SEQ ID NO: 1158 - RNA, 96 nt, synthetic construct
  misc_feature 1..96: note = Synthetic
  source 1..96: mol_type = other RNA
tttttttttcttttttgtacgttttagagctagaaatagcaagttaaaataaggctagtccgttatcaacttgaaaaagtggcaccgagtcggtgc

SEQ ID NO: 1159 - RNA, 96 nt, synthetic construct
  misc_feature 1..96: note = Synthetic
  source 1..96: mol_type = other RNA
ctgttgtcaaagattttaaagttttagagctagaaatagcaagttaaaataaggctagtccgttatcaacttgaaaaagtggcaccgagtcggtgc

SEQ ID NO: 1160 - RNA, 96 nt, synthetic construct
  misc_feature 1..96: note = Synthetic
  source 1..96: mol_type = other RNA
tgacaacagagttctgttttgttttagagctagaaatagcaagttaaaataaggctagtccgttatcaacttgaaaaagtggcaccgagtcggtgc

SEQ ID NO: 1161 - RNA, 96 nt, synthetic construct
  misc_feature 1..96: note = Synthetic
  source 1..96: mol_type = other RNA
agaatacgctgagagttatcgttttagagctagaaatagcaagttaaaataaggctagtccgttatcaacttgaaaaagtggcaccgagtcggtgc

SEQ ID NO: 1162 - RNA, 96 nt, synthetic construct
  misc_feature 1..96: note = Synthetic
  source 1..96: mol_type = other RNA
gcaagagaagaaaagaacgggttttagagctagaaatagcaagttaaaataaggctagtccgttatcaacttgaaaaagtggcaccgagtcggtgc

SEQ ID NO: 1163 - RNA, 96 nt, synthetic construct
  misc_feature 1..96: note = Synthetic
  source 1..96: mol_type = other RNA
gttgcaagagaagaaaagaagttttagagctagaaatagcaagttaaaataaggctagtccgttatcaacttgaaaaagtggcaccgagtcggtgc

SEQ ID NO: 1164 - RNA, 96 nt, synthetic construct
  misc_feature 1..96: note = Synthetic
  source 1..96: mol_type = other RNA
atgcacacgtaaaagagagggttttagagctagaaatagcaagttaaaataaggctagtccgttatcaacttgaaaaagtggcaccgagtcggtgc

SEQ ID NO: 1165 - RNA, 96 nt, synthetic construct
  misc_feature 1..96: note = Synthetic
  source 1..96: mol_type = other RNA
aagatgcacacgtaaaagaggttttagagctagaaatagcaagttaaaataaggctagtccgttatcaacttgaaaaagtggcaccgagtcggtgc

SEQ ID NO: 1166 - RNA, 96 nt, synthetic construct; identical to SEQ ID NO: 1152
  misc_feature 1..96: note = Synthetic
  source 1..96: mol_type = other RNA

SEQ ID NO: 1167 - RNA, 96 nt, synthetic construct; identical to SEQ ID NO: 1153
  misc_feature 1..96: note = Synthetic
  source 1..96: mol_type = other RNA

SEQ ID NO: 1168 - RNA, 96 nt, synthetic construct; identical to SEQ ID NO: 1154
  misc_feature 1..96: note = Synthetic
  source 1..96: mol_type = other RNA

SEQ ID NO: 1169 - RNA, 96 nt, synthetic construct; identical to SEQ ID NO: 1155
  misc_feature 1..96: note = Synthetic
  source 1..96: mol_type = other RNA

SEQ ID NO: 1170 - RNA, 96 nt, synthetic construct; identical to SEQ ID NO: 1156
  misc_feature 1..96: note = Synthetic
  source 1..96: mol_type = other RNA

SEQ ID NO: 1171 - RNA, 96 nt, synthetic construct; identical to SEQ ID NO: 1157
  misc_feature 1..96: note = Synthetic
  source 1..96: mol_type = other RNA

SEQ ID NO: 1172 - RNA, 96 nt, synthetic construct; identical to SEQ ID NO: 1158
  misc_feature 1..96: note = Synthetic
  source 1..96: mol_type = other RNA

SEQ ID NO: 1173 - RNA, 96 nt, synthetic construct; identical to SEQ ID NO: 1159
  misc_feature 1..96: note = Synthetic
  source 1..96: mol_type = other RNA

SEQ ID NO: 1174 - RNA, 96 nt, synthetic construct; identical to SEQ ID NO: 1160
  misc_feature 1..96: note = Synthetic
  source 1..96: mol_type = other RNA

SEQ ID NO: 1175 - RNA, 96 nt, synthetic construct; identical to SEQ ID NO: 1161
  misc_feature 1..96: note = Synthetic
  source 1..96: mol_type = other RNA

SEQ ID NO: 1176 - RNA, 96 nt, synthetic construct; identical to SEQ ID NO: 1162
  misc_feature 1..96: note = Synthetic
  source 1..96: mol_type = other RNA

SEQ ID NO: 1177 - RNA, 96 nt, synthetic construct; identical to SEQ ID NO: 1163
  misc_feature 1..96: note = Synthetic
  source 1..96: mol_type = other RNA

SEQ ID NO: 1178 - RNA, 96 nt, synthetic construct; identical to SEQ ID NO: 1164
  misc_feature 1..96: note = Synthetic
  source 1..96: mol_type = other RNA

SEQ ID NO: 1179 - RNA, 96 nt, synthetic construct; identical to SEQ ID NO: 1165
  misc_feature 1..96: note = Synthetic
  source 1..96: mol_type = other RNA

SEQ ID NO: 1180 - RNA, 96 nt, synthetic construct
  misc_feature 1..96: note = Synthetic
  source 1..96: mol_type = other RNA
ggcagaccgttctcatcacggttttagagctagaaatagcaagttaaaataaggctagtccgttatcaacttgaaaaagtggcaccgagtcggtgc

SEQ ID NO: 1181 - RNA, 96 nt, synthetic construct
  misc_feature 1..96: note = Synthetic
  source 1..96: mol_type = other RNA
ctttaccagtgactccaggtgttttagagctagaaatagcaagttaaaataaggctagtccgttatcaacttgaaaaagtggcaccgagtcggtgc

SEQ ID NO: 1182 - RNA, 96 nt, synthetic construct
  misc_feature 1..96: note = Synthetic
  source 1..96: mol_type = other RNA
gtcacagatttccttctccggttttagagctagaaatagcaagttaaaataaggctagtccgttatcaacttgaaaaagtggcaccgagtcggtgc

SEQ ID NO: 1183 - RNA, 96 nt, synthetic construct
  misc_feature 1..96: note = Synthetic
  source 1..96: mol_type = other RNA
agatgatgacgcccaccagagttttagagctagaaatagcaagttaaaataaggctagtccgttatcaacttgaaaaagtggcaccgagtcggtgc

SEQ ID NO: 1184 - RNA, 96 nt, synthetic construct
  misc_feature 1..96: note = Synthetic
  source 1..96: mol_type = other RNA
ggagaaggaaatctgtgaccgttttagagctagaaatagcaagttaaaataaggctagtccgttatcaacttgaaaaagtggcaccgagtcggtgc

SEQ ID NO: 1185 - RNA, 96 nt, synthetic construct
  misc_feature 1..96: note = Synthetic
  source 1..96: mol_type = other RNA
tgcgaggaacttacttttccgttttagagctagaaatagcaagttaaaataaggctagtccgttatcaacttgaaaaagtggcaccgagtcggtgc

SEQ ID NO: 1186 - RNA, 96 nt, synthetic construct
  misc_feature 1..96: note = Synthetic
  source 1..96: mol_type = other RNA
agagaaatattgatataggagttttagagctagaaatagcaagttaaaataaggctagtccgttatcaacttgaaaaagtggcaccgagtcggtgc

SEQ ID NO: 1187 - RNA, 96 nt, synthetic construct
  misc_feature 1..96: note = Synthetic
  source 1..96: mol_type = other RNA
tatcaatatttctctgatccgttttagagctagaaatagcaagttaaaataaggctagtccgttatcaacttgaaaaagtggcaccgagtcggtgc

SEQ ID NO: 1188 - RNA, 96 nt, synthetic construct
  misc_feature 1..96: note = Synthetic
  source 1..96: mol_type = other RNA
atcgcttttaaggcacgctcgttttagagctagaaatagcaagttaaaataaggctagtccgttatcaacttgaaaaagtggcaccgagtcggtgc

SEQ ID NO: 1189 - RNA, 96 nt, synthetic construct
  misc_feature 1..96: note = Synthetic
  source 1..96: mol_type = other RNA
tatacgactgatcgcttttagttttagagctagaaatagcaagttaaaataaggctagtccgttatcaacttgaaaaagtggcaccgagtcggtgc

SEQ ID NO: 1190 - RNA, 106 nt, synthetic construct
  misc_feature 1..106: note = Synthetic
  source 1..106: mol_type = other RNA
tgtcaggttagttagatgaagtttaagagctatgctggaaacagcatagcaagtttaaataaggctagtccgttatcaacttgaaaaagtggcaccgagtcggtgc

SEQ ID NO: 1191 - RNA, 106 nt, synthetic construct
  misc_feature 1..106: note = Synthetic
  source 1..106: mol_type = other RNA
gtgtcaggttagttagatgagtttaagagctatgctggaaacagcatagcaagtttaaataaggctagtccgttatcaacttgaaaaagtggcaccgagtcggtgc

SEQ ID NO: 1192 - RNA, 106 nt, synthetic construct
  misc_feature 1..106: note = Synthetic
  source 1..106: mol_type = other RNA
cctgacacatatacagactagtttaagagctatgctggaaacagcatagcaagtttaaataaggctagtccgttatcaacttgaaaaagtggcaccgagtcggtgc

SEQ ID NO: 1193 - RNA, 106 nt, synthetic construct
  misc_feature 1..106: note = Synthetic
  source 1..106: mol_type = other RNA
ctgacacatatacagactaagtttaagagctatgctggaaacagcatagcaagtttaaataaggctagtccgttatcaacttgaaaaagtggcaccgagtcggtgc

SEQ ID NO: 1194 - RNA, 106 nt, synthetic construct
  misc_feature 1..106: note = Synthetic
  source 1..106: mol_type = other RNA
ccttagtctgtatatgtgtcgtttaagagctatgctggaaacagcatagcaagtttaaataaggctagtccgttatcaacttgaaaaagtggcaccgagtcggtgc

SEQ ID NO: 1195 - RNA, 106 nt, synthetic construct
  misc_feature 1..106: note = Synthetic
  source 1..106: mol_type = other RNA
catatacagactaagggaccgtttaagagctatgctggaaacagcatagcaagtttaaataaggctagtccgttatcaacttgaaaaagtggcaccgagtcggtgc

SEQ ID NO: 1196 - RNA, 106 nt, synthetic construct
  misc_feature 1..106: note = Synthetic
  source 1..106: mol_type = other RNA
atatacagactaagggaccagtttaagagctatgctggaaacagcatagcaagtttaaataaggctagtccgttatcaacttgaaaaagtggcaccgagtcggtgc

SEQ ID NO: 1197 - RNA, 106 nt, synthetic construct
  misc_feature 1..106: note = Synthetic
  source 1..106: mol_type = other RNA
tcaaagtttgataaattcccgtttaagagctatgctggaaacagcatagcaagtttaaataaggctagtccgttatcaacttgaaaaagtggcaccgagtcggtgc

SEQ ID NO: 1198 - RNA, 106 nt, synthetic construct
  misc_feature 1..106: note = Synthetic
  source 1..106: mol_type = other RNA
aaaatacaaagataagtagagtttaagagctatgctggaaacagcatagcaagtttaaataaggctagtccgttatcaacttgaaaaagtggcaccgagtcggtgc

SEQ ID NO: 1199 - RNA, 106 nt, synthetic construct
  misc_feature 1..106: note = Synthetic
  source 1..106: mol_type = other RNA
actctgtgactttaaaaagtgtttaagagctatgctggaaacagcatagcaagtttaaataaggctagtccgttatcaacttgaaaaagtggcaccgagtcggtgc

SEQ ID NO: 1200 - RNA, 106 nt, synthetic construct
  misc_feature 1..106: note = Synthetic
  source 1..106: mol_type = other RNA
ggttctgtgggatattaatagtttaagagctatgctggaaacagcatagcaagtttaaataaggctagtccgttatcaacttgaaaaagtggcaccgagtcggtgc

SEQ ID NO: 1201 - RNA, 106 nt, synthetic construct
  misc_feature 1..106: note = Synthetic
  source 1..106: mol_type = other RNA
acagagcatattggttctgtgtttaagagctatgctggaaacagcatagcaagtttaaataaggctagtccgttatcaacttgaaaaagtggcaccgagtcggtgc

SEQ ID NO: 1202 - RNA, 106 nt, synthetic construct
  misc_feature 1..106: note = Synthetic
  source 1..106: mol_type = other RNA
gacagagcatattggttctggtttaagagctatgctggaaacagcatagcaagtttaaataaggctagtccgttatcaacttgaaaaagtggcaccgagtcggtgc

SEQ ID NO: 1203 - RNA, 106 nt, synthetic construct
  misc_feature 1..106: note = Synthetic
  source 1..106: mol_type = other RNA
tgcaaaacgacagagcatatgtttaagagctatgctggaaacagcatagcaagtttaaataaggctagtccgttatcaacttgaaaaagtggcaccgagtcggtgc

SEQ ID NO: 1204 - RNA, 106 nt, synthetic construct
  misc_feature 1..106: note = Synthetic
  source 1..106: mol_type = other RNA
gagctgggcatggaataggcgtttaagagctatgctggaaacagcatagcaagtttaaataaggctagtccgttatcaacttgaaaaagtggcaccgagtcggtgc

SEQ ID NO: 1205 - RNA, 106 nt, synthetic construct
  misc_feature 1..106: note = Synthetic
  source 1..106: mol_type = other RNA
actggagctgggcatggaatgtttaagagctatgctggaaacagcatagcaagtttaaataaggctagtccgttatcaacttgaaaaagtggcaccgagtcggtgc

SEQ ID NO: 1206 - RNA, 106 nt, synthetic construct
  misc_feature 1..106: note = Synthetic
  source 1..106: mol_type = other RNA
ctcattactggagctgggcagtttaagagctatgctggaaacagcatagcaagtttaaataaggctagtccgttatcaacttgaaaaagtggcaccgagtcggtgc

SEQ ID NO: 1207 - RNA, 106 nt, synthetic construct
  misc_feature 1..106: note = Synthetic
  source 1..106: mol_type = other RNA
ttgttctcattactggagctgtttaagagctatgctggaaacagcatagcaagtttaaataaggctagtccgttatcaacttgaaaaagtggcaccgagtcggtgc

SEQ ID NO: 1208 - RNA, 106 nt, synthetic construct
  misc_feature 1..106: note = Synthetic
  source 1..106: mol_type = other RNA
attgttctcattactggagcgtttaagagctatgctggaaacagcatagcaagtttaaataaggctagtccgttatcaacttgaaaaagtggcaccgagtcggtgc

SEQ ID NO: 1209 - RNA, 106 nt, synthetic construct
  misc_feature 1..106: note = Synthetic
  source 1..106: mol_type = other RNA
ggggagattgttctcattacgtttaagagctatgctggaaacagcatagcaagtttaaataaggctagtccgttatcaacttgaaaaagtggcaccgagtcggtgc

SEQ ID NO: 1210 - RNA, 106 nt, synthetic construct
  misc_feature 1..106: note = Synthetic
  source 1..106: mol_type = other RNA
gaggagaaaatctgtggctggtttaagagctatgctggaaacagcatagcaagtttaaataaggctagtccgttatcaacttgaaaaagtggcaccgagtcggtgc

SEQ ID NO: 1211 - RNA, 106 nt, synthetic construct
  misc_feature 1..106: note = Synthetic
  source 1..106: mol_type = other RNA
agaggagaaaatctgtggctgtttaagagctatgctggaaacagcatagcaagtttaaataaggctagtccgttatcaacttgaaaaagtggcaccgagtcggtgc

SEQ ID NO: 1212 - RNA, 106 nt, synthetic construct
  misc_feature 1..106: note = Synthetic
  source 1..106: mol_type = other RNA
cagaggagaaaatctgtggcgtttaagagctatgctggaaacagcatagcaagtttaaataaggctagtccgttatcaacttgaaaaagtggcaccgagtcggtgc

SEQ ID NO: 1213 - RNA, 106 nt, synthetic construct
  misc_feature 1..106: note = Synthetic
  source 1..106: mol_type = other RNA
tcctcagaggagaaaatctggtttaagagctatgctggaaacagcatagcaagtttaaataaggctagtccgttatcaacttgaaaaagtggcaccgagtcggtgc

SEQ ID NO: 1214 - RNA, 106 nt, synthetic construct
  misc_feature 1..106: note = Synthetic
  source 1..106: mol_type = other RNA
tgaagtttttcattcctcaggtttaagagctatgctggaaacagcatagcaagtttaaataaggctagtccgttatcaacttgaaaaagtggcaccgagtcggtgc

SEQ ID NO: 1215 - RNA, 106 nt, synthetic construct
  misc_feature 1..106: note = Synthetic
  source 1..106: mol_type = other RNA
cttcaccaacgactccaagtgtttaagagctatgctggaaacagcatagcaagtttaaataaggctagtccgttatcaacttgaaaaagtggcaccgagtcggtgc

SEQ ID NO: 1216 - RNA, 106 nt, synthetic construct
  misc_feature 1..106: note = Synthetic
  source 1..106: mol_type = other RNA
ctactcctacttggagtcgtgtttaagagctatgctggaaacagcatagcaagtttaaataaggctagtccgttatcaacttgaaaaagtggcaccgagtcggtgc

SEQ ID NO: 1217 - RNA, 106 nt, synthetic construct
  misc_feature 1..106: note = Synthetic
  source 1..106: mol_type = other RNA
ctccaagtaggagtagatgagtttaagagctatgctggaaacagcatagcaagtttaaataaggctagtccgttatcaacttgaaaaagtggcaccgagtcggtgc

SEQ ID NO: 1218 - RNA, 106 nt, synthetic construct
  misc_feature 1..106: note = Synthetic
  source 1..106: mol_type = other RNA
caccatcatctactcctactgtttaagagctatgctggaaacagcatagcaagtttaaataaggctagtccgttatcaacttgaaaaagtggcaccgagtcggtgc

SEQ ID NO: 1219 - RNA, 106 nt, synthetic construct
  misc_feature 1..106: note = Synthetic
  source 1..106: mol_type = other RNA
tgatggtgatcagaagcagagtttaagagctatgctggaaacagcatagcaagtttaaataaggctagtccgttatcaacttgaaaaagtggcaccgagtcggtgc

SEQ ID NO: 1220 - RNA, 106 nt, synthetic construct
  misc_feature 1..106: note = Synthetic
  source 1..106: mol_type = other RNA
tcagaagcagaaggatttctgtttaagagctatgctggaaacagcatagcaagtttaaataaggctagtccgttatcaacttgaaaaagtggcaccgagtcggtgc

SEQ ID NO: 1221 - RNA, 106 nt, synthetic construct
  misc_feature 1..106: note = Synthetic
  source 1..106: mol_type = other RNA
gatttctaggatgatgttcagtttaagagctatgctggaaacagcatagcaagtttaaataaggctagtccgttatcaacttgaaaaagtggcaccgagtcggtgc

SEQ ID NO: 1222 - RNA, 106 nt, synthetic construct
  misc_feature 1..106: note = Synthetic
  source 1..106: mol_type = other RNA
ttgctctgtcctcttccttcgtttaagagctatgctggaaacagcatagcaagtttaaataaggctagtccgttatcaacttgaaaaagtggcaccgagtcggtgc

SEQ ID NO: 1223 - RNA, 106 nt, synthetic construct
  misc_feature 1..106: note = Synthetic
  source 1..106: mol_type = other RNA
aggactgaaccagaaggaaggtttaagagctatgctggaaacagcatagcaagtttaaataaggctagtccgttatcaacttgaaaaagtggcaccgagtcggtgc

SEQ ID NO: 1224 - RNA, 106 nt, synthetic construct
  misc_feature 1..106: note = Synthetic
  source 1..106: mol_type = other RNA
tacacaaggactgaaccagagtttaagagctatgctggaaacagcatagcaagtttaaataaggctagtccgttatcaacttgaaaaagtggcaccgagtcggtgc

SEQ ID NO: 1225 - RNA, 106 nt, synthetic construct
  misc_feature 1..106: note = Synthetic
  source 1..106: mol_type = other RNA
ttcagtccttgtgtagtcctgtttaagagctatgctggaaacagcatagcaagtttaaataaggctagtccgttatcaacttgaaaaagtggcaccgagtcggtgc

SEQ ID NO: 1226 - RNA, 106 nt, synthetic construct
  misc_feature 1..106: note = Synthetic
  source 1..106: mol_type = other RNA
tcagtccttgtgtagtcctagtttaagagctatgctggaaacagcatagcaagtttaaataaggctagtccgttatcaacttgaaaaagtggcaccgagtcggtgc

SEQ ID NO: 1227 - RNA, 106 nt, synthetic construct
  misc_feature 1..106: note = Synthetic
  source 1..106: mol_type = other RNA
gtccttgtgtagtcctaggggtttaagagctatgctggaaacagcatagcaagtttaaataaggctagtccgttatcaacttgaaaaagtggcaccgagtcggtgc

SEQ ID NO: 1228 - RNA, 106 nt, synthetic construct
  misc_feature 1..106: note = Synthetic
  source 1..106: mol_type = other RNA
cttgtgtagtcctagggagggtttaagagctatgctggaaacagcatagcaagtttaaataaggctagtccgttatcaacttgaaaaagtggcaccgagtcggtgc

SEQ ID NO: 1229 - RNA, 106 nt, synthetic construct
  misc_feature 1..106: note = Synthetic
  source 1..106: mol_type = other RNA
ctcctccctaggactacacagtttaagagctatgctggaaacagcatagcaagtttaaataaggctagtccgttatcaacttgaaaaagtggcaccgagtcggtgc

SEQ ID NO: 1230 - RNA, 106 nt, synthetic construct
  misc_feature 1..106: note = Synthetic
  source 1..106: mol_type = other RNA
gtagacagtacctcctccctgtttaagagctatgctggaaacagcatagcaagtttaaataaggctagtccgttatcaacttgaaaaagtggcaccgagtcggtgc

SEQ ID NO: 1231 - RNA, 106 nt, synthetic construct
  misc_feature 1..106: note = Synthetic
  source 1..106: mol_type = other RNA
tactgtctacacagagctctgtttaagagctatgctggaaacagcatagcaagtttaaataaggctagtccgttatcaacttgaaaaagtggcaccgagtcggtgc

SEQ ID NO: 1232 - RNA, 106 nt, synthetic construct
  misc_feature 1..106: note = Synthetic
  source 1..106: mol_type = other RNA
actgtctacacagagctctagtttaagagctatgctggaaacagcatagcaagtttaaataaggctagtccgttatcaacttgaaaaagtggcaccgagtcggtgc

SEQ ID NO: 1233 - RNA, 106 nt, synthetic construct
  misc_feature 1..106: note = Synthetic
  source 1..106: mol_type = other RNA
tctacacagagctctagggagtttaagagctatgctggaaacagcatagcaagtttaaataaggctagtccgttatcaacttgaaaaagtggcaccgagtcggtgc

SEQ ID NO: 1234 - RNA, 106 nt, synthetic construct
  misc_feature 1..106: note = Synthetic
  source 1..106: mol_type = other RNA
ctacacagagctctagggaagtttaagagctatgctggaaacagcatagcaagtttaaataaggctagtccgttatcaacttgaaaaagtggcaccgagtcggtgc

SEQ ID NO: 1235 - RNA, 106 nt, synthetic construct
  misc_feature 1..106: note = Synthetic
  source 1..106: mol_type = other RNA
tacacagagctctagggaaggtttaagagctatgctggaaacagcatagcaagtttaaataaggctagtccgttatcaacttgaaaaagtggcaccgagtcggtgc

SEQ ID NO: 1236 - RNA, 106 nt, synthetic construct
  misc_feature 1..106: note = Synthetic
  source 1..106: mol_type = other RNA
ggggtgtgcccagttgttaagtttaagagctatgctggaaacagcatagcaagtttaaataaggctagtccgttatcaacttgaaaaagtggcaccgagtcggtgc

SEQ ID NO: 1237 - RNA, 106 nt, synthetic construct
  misc_feature 1..106: note = Synthetic
  source 1..106: mol_type = other RNA
gggtgtgcccagttgttaatgtttaagagctatgctggaaacagcatagcaagtttaaataaggctagtccgttatcaacttgaaaaagtggcaccgagtcggtgc

SEQ ID NO: 1238 - RNA, 106 nt, synthetic construct
  misc_feature 1..106: note = Synthetic
  source 1..106: mol_type = other RNA
tggtagtcccattaacaactgtttaagagctatgctggaaacagcatagcaagtttaaataaggctagtccgttatcaacttgaaaaagtggcaccgagtcggtgc

SEQ ID NO: 1239 - RNA, 106 nt, synthetic construct
  misc_feature 1..106: note = Synthetic
  source 1..106: mol_type = other RNA
ctggtagtcccattaacaacgtttaagagctatgctggaaacagcatagcaagtttaaataaggctagtccgttatcaacttgaaaaagtggcaccgagtcggtgc

SEQ ID NO: 1240 - RNA, 106 nt, synthetic construct
  misc_feature 1..106: note = Synthetic
  source 1..106: mol_type = other RNA
ttgttaatgggactaccagagtttaagagctatgctggaaacagcatagcaagtttaaataaggctagtccgttatcaacttgaaaaagtggcaccgagtcggtgc

SEQ ID NO: 1241 - RNA, 106 nt, synthetic construct
  misc_feature 1..106: note = Synthetic
  source 1..106: mol_type = other RNA
taccagatggaagccagcttgtttaagagctatgctggaaacagcatagcaagtttaaataaggctagtccgttatcaacttgaaaaagtggcaccgagtcggtgc

SEQ ID NO: 1242 - RNA, 106 nt, synthetic construct
  misc_feature 1..106: note = Synthetic
  source 1..106: mol_type = other RNA
ttccaaagctggcttccatcgtttaagagctatgctggaaacagcatagcaagtttaaataaggctagtccgttatcaacttgaaaaagtggcaccgagtcggtgc

SEQ ID NO: 1243 - RNA, 106 nt, synthetic construct
  misc_feature 1..106: note = Synthetic
  source 1..106: mol_type = other RNA
tggaagccagctttggaagcgtttaagagctatgctggaaacagcatagcaagtttaaataaggctagtccgttatcaacttgaaaaagtggcaccgagtcggtgc

SEQ ID NO: 1244 - RNA, 106 nt, synthetic construct
  misc_feature 1..106: note = Synthetic
  source 1..106: mol_type = other RNA
acaaggcctgcttccaaagcgtttaagagctatgctggaaacagcatagcaagtttaaataaggctagtccgttatcaacttgaaaaagtggcaccgagtcggtgc

SEQ ID NO: 1245 - RNA, 106 nt, synthetic construct
  misc_feature 1..106: note = Synthetic
  source 1..106: mol_type = other RNA
gccttgttcacgtgttctaagtttaagagctatgctggaaacagcatagcaagtttaaataaggctagtccgttatcaacttgaaaaagtggcaccgagtcggtgc

SEQ ID NO: 1246 - RNA, 106 nt, synthetic construct
  misc_feature 1..106: note = Synthetic
  source 1..106: mol_type = other RNA
ccttgttcacgtgttctaatgtttaagagctatgctggaaacagcatagcaagtttaaataaggctagtccgttatcaacttgaaaaagtggcaccgagtcggtgc

SEQ ID NO: 1247 - RNA, 106 nt, synthetic construct
  misc_feature 1..106: note = Synthetic
  source 1..106: mol_type = other RNA
cccattagaacacgtgaacagtttaagagctatgctggaaacagcatagcaagtttaaataaggctagtccgttatcaacttgaaaaagtggcaccgagtcggtgc

SEQ ID NO: 1248 - RNA, 106 nt, synthetic construct
  misc_feature 1..106: note = Synthetic
  source 1..106: mol_type = other RNA
ttggcatcacttcatatttggtttaagagctatgctggaaacagcatagcaagtttaaataaggctagtccgttatcaacttgaaaaagtggcaccgagtcggtgc

SEQ ID NO: 1249 - RNA, 106 nt, synthetic construct
  misc_feature 1..106: note = Synthetic
  source 1..106: mol_type = other RNA
cttgtgctcttggcatcactgtttaagagctatgctggaaacagcatagcaagtttaaataaggctagtccgttatcaacttgaaaaagtggcaccgagtcggtgc

SEQ ID NO: 1250 - RNA, 106 nt, synthetic construct
  misc_feature 1..106: note = Synthetic
  source 1..106: mol_type = other RNA
agcacactctcttgtgctctgtttaagagctatgctggaaacagcatagcaagtttaaataaggctagtccgttatcaacttgaaaaagtggcaccgagtcggtgc

SEQ ID NO: 1251 - RNA, 106 nt, synthetic construct
  misc_feature 1..106: note = Synthetic
  source 1..106: mol_type = other RNA
gcacaagagagtgtgctctcgtttaagagctatgctggaaacagcatagcaagtttaaataaggctagtccgttatcaacttgaaaaagtggcaccgagtcggtgc

SEQ ID NO: 1252 - RNA, 106 nt, synthetic construct
  misc_feature 1..106: note = Synthetic
  source 1..106: mol_type = other RNA
gcttaatctcacacatagaagtttaagagctatgctggaaacagcatagcaagtttaaataaggctagtccgttatcaacttgaaaaagtggcaccgagtcggtgc

SEQ ID NO: 1253 - RNA, 106 nt, synthetic construct
  misc_feature 1..106: note = Synthetic
  source 1..106: mol_type = other RNA
cttaatctcacacatagaaagtttaagagctatgctggaaacagcatagcaagtttaaataaggctagtccgttatcaacttgaaaaagtggcaccgagtcggtgc

SEQ ID NO: 1254 - RNA, 106 nt, synthetic construct
  misc_feature 1..106: note = Synthetic
  source 1..106: mol_type = other RNA
ttaatctcacacatagaaaggtttaagagctatgctggaaacagcatagcaagtttaaataaggctagtccgttatcaacttgaaaaagtggcaccgagtcggtgc

SEQ ID NO: 1255 - RNA, 106 nt, synthetic construct
  misc_feature 1..106: note = Synthetic
  source 1..106: mol_type = other RNA
aggagtgctggtttatcaacgtttaagagctatgctggaaacagcatagcaagtttaaataaggctagtccgttatcaacttgaaaaagtggcaccgagtcggtgc

SEQ ID NO: 1256 - RNA, 106 nt, synthetic construct
  misc_feature 1..106: note = Synthetic
  source 1..106: mol_type = other RNA
ttctttgacagcaggagtgcgtttaagagctatgctggaaacagcatagcaagtttaaataaggctagtccgttatcaacttgaaaaagtggcaccgagtcggtgc

SEQ ID NO: 1257 - RNA, 106 nt, synthetic construct
  misc_feature 1..106: note = Synthetic
  source 1..106: mol_type = other RNA
actctggtttctttgacagcgtttaagagctatgctggaaacagcatagcaagtttaaataaggctagtccgttatcaacttgaaaaagtggcaccgagtcggtgc

SEQ ID NO: 1258 - RNA, 106 nt, synthetic construct
  misc_feature 1..106: note = Synthetic
  source 1..106: mol_type = other RNA
accagagttgagaaaaccccgtttaagagctatgctggaaacagcatagcaagtttaaataaggctagtccgttatcaacttgaaaaagtggcaccgagtcggtgc

SEQ ID NO: 1259 - RNA, 106 nt, synthetic construct
  misc_feature 1..106: note = Synthetic
  source 1..106: mol_type = other RNA
tccaggggttttctcaactcgtttaagagctatgctggaaacagcatagcaagtttaaataaggctagtccgttatcaacttgaaaaagtggcaccgagtcggtgc

SEQ ID NO: 1260 - RNA, 106 nt, synthetic construct
  misc_feature 1..106: note = Synthetic
  source 1..106: mol_type = other RNA
cagttattaaatgaatccaggtttaagagctatgctggaaacagcatagcaagtttaaataaggctagtccgttatcaacttgaaaaagtggcaccgagtcggtgc

SEQ ID NO: 1261 - RNA, 106 nt, synthetic construct
  misc_feature 1..106: note = Synthetic
  source 1..106: mol_type = other RNA
gcagttattaaatgaatccagtttaagagctatgctggaaacagcatagcaagtttaaataaggctagtccgttatcaacttgaaaaagtggcaccgagtcggtgc

SEQ ID NO: 1262 - RNA, 106 nt, synthetic construct
  misc_feature 1..106: note = Synthetic
  source 1..106: mol_type = other RNA
ggcagttattaaatgaatccgtttaagagctatgctggaaacagcatagcaagtttaaataaggctagtccgttatcaacttgaaaaagtggcaccgagtcggtgc

SEQ ID NO: 1263 - RNA, 106 nt, synthetic construct
  misc_feature 1..106: note = Synthetic
  source 1..106: mol_type = other RNA
tggatggtaacagctacatcgtttaagagctatgctggaaacagcatagcaagtttaaataaggctagtccgttatcaacttgaaaaagtggcaccgagtcggtgc

SEQ ID NO: 1264 - RNA, 106 nt, synthetic construct
  misc_feature 1..106: note = Synthetic
  source 1..106: mol_type = other RNA
gctgttaccatccacatcctgtttaagagctatgctggaaacagcatagcaagtttaaataaggctagtccgttatcaacttgaaaaagtggcaccgagtcggtgc

SEQ ID NO: 1265 - RNA, 106 nt, synthetic construct
  misc_feature 1..106: note = Synthetic
  source 1..106: mol_type = other RNA
tcaagaaccaaggatgtggagtttaagagctatgctggaaacagcatagcaagtttaaataaggctagtccgttatcaacttgaaaaagtggcaccgagtcggtgc

SEQ ID NO: 1266 - RNA, 106 nt, synthetic construct
  misc_feature 1..106: note = Synthetic
  source 1..106: mol_type = other RNA
tccttcaagaaccaaggatggtttaagagctatgctggaaacagcatagcaagtttaaataaggctagtccgttatcaacttgaaaaagtggcaccgagtcggtgc

SEQ ID NO: 1267 - RNA, 106 nt, synthetic construct
  misc_feature 1..106: note = Synthetic
  source 1..106: mol_type = other RNA
tgagtgtccttcaagaaccagtttaagagctatgctggaaacagcatagcaagtttaaataaggctagtccgttatcaacttgaaaaagtggcaccgagtcggtgc

SEQ ID NO: 1268 - RNA, 106 nt, synthetic construct
  misc_feature 1..106: note = Synthetic
  source 1..106: mol_type = other RNA
ttttattttataactacaaggtttaagagctatgctggaaacagcatagcaagtttaaataaggctagtccgttatcaacttgaaaaagtggcaccgagtcggtgc

SEQ ID NO: 1269 - RNA, 106 nt, synthetic construct
  misc_feature 1..106: note = Synthetic
  source 1..106: mol_type = other RNA
ttgtttttaataaaaacaaggtttaagagctatgctggaaacagcatagcaagtttaaataaggctagtccgttatcaacttgaaaaagtggcaccgagtcggtgc

SEQ ID NO: 1270 - RNA, 106 nt, synthetic construct
  misc_feature 1..106: note = Synthetic
  source 1..106: mol_type = other RNA
tattatagaatgcttttgcagtttaagagctatgctggaaacagcatagcaagtttaaataaggctagtccgttatcaacttgaaaaagtggcaccgagtcggtgc

SEQ ID NO: 1271 - RNA, 106 nt, synthetic construct
  misc_feature 1..106: note = Synthetic
  source 1..106: mol_type = other RNA
caagattagtcttgatgtaggtttaagagctatgctggaaacagcatagcaagtttaaataaggctagtccgttatcaacttgaaaaagtggcaccgagtcggtgc

SEQ ID NO: 1272 - RNA, 106 nt, synthetic construct
  misc_feature 1..106: note = Synthetic
  source 1..106: mol_type = other RNA
aagattagtcttgatgtagtgtttaagagctatgctggaaacagcatagcaagtttaaataaggctagtccgttatcaacttgaaaaagtggcaccgagtcggtgc

SEQ ID NO: 1273 - RNA, 106 nt, synthetic construct
  misc_feature 1..106: note = Synthetic
  source 1..106: mol_type = other RNA
agtcttgatgtagtgggagtgtttaagagctatgctggaaacagcatagcaagtttaaataaggctagtccgttatcaacttgaaaaagtggcaccgagtcggtgc

SEQ ID NO: 1274 - RNA, 106 nt, synthetic construct
  misc_feature 1..106: note = Synthetic
  source 1..106: mol_type = other RNA
tttttctattaaaaaaaaaagtttaagagctatgctggaaacagcatagcaagtttaaataaggctagtccgttatcaacttgaaaaagtggcaccgagtcggtgc

SEQ ID NO: 1275 - RNA, 106 nt, synthetic construct
  misc_feature 1..106: note = Synthetic
  source 1..106: mol_type = other RNA
tctattaaaaaaaaaaaggcgtttaagagctatgctggaaacagcatagcaagtttaaataaggctagtccgttatcaacttgaaaaagtggcaccgagtcggtgc

SEQ ID NO: 1276 - RNA, 106 nt, synthetic construct
  misc_feature 1..106: note = Synthetic
  source 1..106: mol_type = other RNA
ctattaaaaaaaaaaaggctgtttaagagctatgctggaaacagcatagcaagtttaaataaggctagtccgttatcaacttgaaaaagtggcaccgagtcggtgc

SEQ ID NO: 1277 - RNA, 106 nt, synthetic construct
  misc_feature 1..106: note = Synthetic
  source 1..106: mol_type = other RNA
aaaaaaaaaaaggctgggcagtttaagagctatgctggaaacagcatagcaagtttaaataaggctagtccgttatcaacttgaaaaagtggcaccgagtcggtgc

SEQ ID NO: 1278 - RNA, 106 nt, synthetic construct
  misc_feature 1..106: note = Synthetic
  source 1..106: mol_type = other RNA
aaaaaaaaggctgggcacgggtttaagagctatgctggaaacagcatagcaagtttaaataaggctagtccgttatcaacttgaaaaagtggcaccgagtcggtgc

SEQ ID NO: 1279 - RNA, 106 nt, synthetic construct
  misc_feature 1..106: note = Synthetic
  source 1..106: mol_type = other RNA
cacccgtaatcccagcacttgtttaagagctatgctggaaacagcatagcaagtttaaataaggctagtccgttatcaacttgaaaaagtggcaccgagtcggtgc

SEQ ID NO: 1280 - RNA, 106 nt, synthetic construct
  misc_feature 1..106: note = Synthetic
  source 1..106: mol_type = other RNA
acccgtaatcccagcactttgtttaagagctatgctggaaacagcatagcaagtttaaataaggctagtccgttatcaacttgaaaaagtggcaccgagtcggtgc

SEQ ID NO: 1281 - RNA, 106 nt, synthetic construct
  misc_feature 1..106: note = Synthetic
  source 1..106: mol_type = other RNA
cgtaatcccagcactttggggtttaagagctatgctggaaacagcatagcaagtttaaataaggctagtccgttatcaacttgaaaaagtggcaccgagtcggtgc

SEQ ID NO: 1282 - RNA, 106 nt, synthetic construct
  misc_feature 1..106: note = Synthetic
  source 1..106: mol_type = other RNA
tcccaaagtgctgggattacgtttaagagctatgctggaaacagcatagcaagtttaaataaggctagtccgttatcaacttgaaaaagtggcaccgagtcggtgc

SEQ ID NO: 1283 - RNA, 106 nt, synthetic construct
  misc_feature 1..106: note = Synthetic
  source 1..106: mol_type = other RNA
ctcccaaagtgctgggattagtttaagagctatgctggaaacagcatagcaagtttaaataaggctagtccgttatcaacttgaaaaagtggcaccgagtcggtgc

SEQ ID NO: 1284 - RNA, 106 nt, synthetic construct
  misc_feature 1..106: note = Synthetic
  source 1..106: mol_type = other RNA
cccagcactttgggaggccggtttaagagctatgctggaaacagcatagcaagtttaaataaggctagtccgttatcaacttgaaaaagtggcaccgagtcggtgc

SEQ ID NO: 1285 - RNA, 106 nt, synthetic construct
  misc_feature 1..106: note = Synthetic
  source 1..106: mol_type = other RNA
cctcggcctcccaaagtgctgtttaagagctatgctggaaacagcatagcaagtttaaataaggctagtccgttatcaacttgaaaaagtggcaccgagtcggtgc

SEQ ID NO: 1286 - RNA, 106 nt, synthetic construct
  misc_feature 1..106: note = Synthetic
  source 1..106: mol_type = other RNA
gcactttgggaggccgaggcgtttaagagctatgctggaaacagcatagcaagtttaaataaggctagtccgttatcaacttgaaaaagtggcaccgagtcggtgc

SEQ ID NO: 1287 - RNA, 106 nt, synthetic construct
  misc_feature 1..106: note = Synthetic
  source 1..106: mol_type = other RNA
ctttgggaggccgaggcagggtttaagagctatgctggaaacagcatagcaagtttaaataaggctagtccgttatcaacttgaaaaagtggcaccgagtcggtgc

SEQ ID NO: 1288 - RNA, 106 nt, synthetic construct
  misc_feature 1..106: note = Synthetic
  source 1..106: mol_type = other RNA
gccgaggcaggtggatcacggtttaagagctatgctggaaacagcatagcaagtttaaataaggctagtccgttatcaacttgaaaaagtggcaccgagtcggtgc

SEQ ID NO: 1289 - RNA, 106 nt, synthetic construct
  misc_feature 1..106: note = Synthetic
  source 1..106: mol_type = other RNA
acctcgtgatccacctgcctgtttaagagctatgctggaaacagcatagcaagtttaaataaggctagtccgttatcaacttgaaaaagtggcaccgagtcggtgc

SEQ ID NO: 1290 - RNA, 106 nt, synthetic construct
  misc_feature 1..106: note = Synthetic
  source 1..106: mol_type = other RNA
ggcaggtggatcacgaggtcgtttaagagctatgctggaaacagcatagcaagtttaaataaggctagtccgttatcaacttgaaaaagtggcaccgagtcggtgc

SEQ ID NO: 1291 - RNA, 106 nt, synthetic construct
  misc_feature 1..106: note = Synthetic
  source 1..106: mol_type = other RNA
tcaggagatcgagaccatctgtttaagagctatgctggaaacagcatagcaagtttaaataaggctagtccgttatcaacttgaaaaagtggcaccgagtcggtgc

SEQ ID NO: 1292 - RNA, 106 nt, synthetic construct
  misc_feature 1..106: note = Synthetic
  source 1..106: mol_type = other RNA
cgagaccatcttggctaacagtttaagagctatgctggaaacagcatagcaagtttaaataaggctagtccgttatcaacttgaaaaagtggcaccgagtcggtgc

SEQ ID NO: 1293 - RNA, 106 nt, synthetic construct
  misc_feature 1..106: note = Synthetic
  source 1..106: mol_type = other RNA
tttcaccatgttagccaagagtttaagagctatgctggaaacagcatagcaagtttaaataaggctagtccgttatcaacttgaaaaagtggcaccgagtcggtgc

SEQ ID NO: 1294 - RNA, 106 nt, synthetic construct
  misc_feature 1..106: note = Synthetic
  source 1..106: mol_type = other RNA
ttgtattttttgtagagacggtttaagagctatgctggaaacagcatagcaagtttaaataaggctagtccgttatcaacttgaaaaagtggcaccgagtcggtgc

SEQ ID NO: 1295 - RNA, 106 nt, synthetic construct
  misc_feature 1..106: note = Synthetic
  source 1..106: mol_type = other RNA
tttgtattttttgtagagacgtttaagagctatgctggaaacagcatagcaagtttaaataaggctagtccgttatcaacttgaaaaagtggcaccgagtcggtgc

SEQ ID NO: 1296 - RNA, 106 nt, synthetic construct
  misc_feature 1..106: note = Synthetic
  source 1..106: mol_type = other RNA
ttttgtattttttgtagagagtttaagagctatgctggaaacagcatagcaagtttaaataaggctagtccgttatcaacttgaaaaagtggcaccgagtcggtgc

SEQ ID NO: 1297 - RNA, 106 nt, synthetic construct
  misc_feature 1..106: note = Synthetic
  source 1..106: mol_type = other RNA
aaaaaatacaaaaaattagcgtttaagagctatgctggaaacagcatagcaagtttaaataaggctagtccgttatcaacttgaaaaagtggcaccgagtcggtgc

SEQ ID NO: 1298 - RNA, 106 nt, synthetic construct
  misc_feature 1..106: note = Synthetic
  source 1..106: mol_type = other RNA
aaaaatacaaaaaattagccgtttaagagctatgctggaaacagcatagcaagtttaaataaggctagtccgttatcaacttgaaaaagtggcaccgagtcggtgc

SEQ ID NO: 1299 - RNA, 106 nt, synthetic construct
  misc_feature 1..106: note = Synthetic
  source 1..106: mol_type = other RNA
tacaaaaaattagccgggtggtttaagagctatgctggaaacagcatagcaagtttaaataaggctagtccgttatcaacttgaaaaagtggcaccgagtcggtgc

SEQ ID NO: 1300 - RNA, 106 nt, synthetic construct
  misc_feature 1..106: note = Synthetic
  source 1..106: mol_type = other RNA
aaaaaattagccgggtgtgggtttaagagctatgctggaaacagcatagcaagtttaaataaggctagtccgttatcaacttgaaaaagtggcaccgagtcggtgc

SEQ ID NO: 1301 - RNA, 106 nt, synthetic construct
  misc_feature 1..106: note = Synthetic
  source 1..106: mol_type = other RNA
aaattagccgggtgtggtgggtttaagagctatgctggaaacagcatagcaagtttaaataaggctagtccgttatcaacttgaaaaagtggcaccgagtcggtgc

SEQ ID NO: 1302 - RNA, 106 nt, synthetic construct
  misc_feature 1..106: note = Synthetic
  source 1..106: mol_type = other RNA
aattagccgggtgtggtggcgtttaagagctatgctggaaacagcatagcaagtttaaataaggctagtccgttatcaacttgaaaaagtggcaccgagtcggtgc

SEQ ID NO: 1303 - RNA, 106 nt, synthetic construct
  misc_feature 1..106: note = Synthetic
  source 1..106: mol_type = other RNA
caggcgcccgccaccacaccgtttaagagctatgctggaaacagcatagcaagtttaaataaggctagtccgttatcaacttgaaaaagtggcaccgagtcggtgc

SEQ ID NO: 1304 - RNA, 106 nt, synthetic construct
  misc_feature 1..106: note = Synthetic
  source 1..106: mol_type = other RNA
gcctgtagtcccagctactcgtttaagagctatgctggaaacagcatagcaagtttaaataaggctagtccgttatcaacttgaaaaagtggcaccgagtcggtgc

SEQ ID NO: 1305 - RNA, 106 nt, synthetic construct
  misc_feature 1..106: note = Synthetic
  source 1..106: mol_type = other RNA
tgtagtcccagctactcagggtttaagagctatgctggaaacagcatagcaagtttaaataaggctagtccgttatcaacttgaaaaagtggcaccgagtcggtgc

SEQ ID NO: 1306 - RNA, 106 nt, synthetic construct
  misc_feature 1..106: note = Synthetic
  source 1..106: mol_type = other RNA
tcctgagtagctgggactacgtttaagagctatgctggaaacagcatagcaagtttaaataaggctagtccgttatcaacttgaaaaagtggcaccgagtcggtgc

SEQ ID NO: 1307 - RNA, 106 nt, synthetic construct
  misc_feature 1..106: note = Synthetic
  source 1..106: mol_type = other RNA
cccagctactcaggaggctggtttaagagctatgctggaaacagcatagcaagtttaaataaggctagtccgttatcaacttgaaaaagtggcaccgagtcggtgc

SEQ ID NO: 1308 - RNA, 106 nt, synthetic construct
  misc_feature 1..106: note = Synthetic
  source 1..106: mol_type = other RNA
cctcagcctcctgagtagctgtttaagagctatgctggaaacagcatagcaagtttaaataaggctagtccgttatcaacttgaaaaagtggcaccgagtcggtgc

SEQ ID NO: 1309 - RNA, 106 nt, synthetic construct
  misc_feature 1..106: note = Synthetic
  source 1..106: mol_type = other RNA
gcctcagcctcctgagtagcgtttaagagctatgctggaaacagcatagcaagtttaaataaggctagtccgttatcaacttgaaaaagtggcaccgagtcggtgc

SEQ ID NO: 1310 - RNA, 106 nt, synthetic construct
  misc_feature 1..106: note = Synthetic
  source 1..106: mol_type = other RNA
aggaggctgaggcaggagaagtttaagagctatgctggaaacagcatagcaagtttaaataaggctagtccgttatcaacttgaaaaagtggcaccgagtcggtgc

SEQ ID NO: 1311 - RNA, 106 nt, synthetic construct
  misc_feature 1..106: note = Synthetic
  source 1..106: mol_type = other RNA
gcaggagaatggcgtgaaccgtttaagagctatgctggaaacagcatagcaagtttaaataaggctagtccgttatcaacttgaaaaagtggcaccgagtcggtgc

SEQ ID NO: 1312 - RNA, 106 nt, synthetic construct
  misc_feature 1..106: note = Synthetic
  source 1..106: mol_type = other RNA
caggagaatggcgtgaacccgtttaagagctatgctggaaacagcatagcaagtttaaataaggctagtccgttatcaacttgaaaaagtggcaccgagtcggtgc

SEQ ID NO: 1313 - RNA, 106 nt, synthetic construct
  misc_feature 1..106: note = Synthetic
  source 1..106: mol_type = other RNA
gagaatggcgtgaacccggggtttaagagctatgctggaaacagcatagcaagtttaaataaggctagtccgttatcaacttgaaaaagtggcaccgagtcggtgc

SEQ ID NO: 1314 - RNA, 106 nt, synthetic construct
  misc_feature 1..106: note = Synthetic
  source 1..106: mol_type = other RNA
aatggcgtgaacccgggagggtttaagagctatgctggaaacagcatagcaagtttaaataaggctagtccgttatcaacttgaaaaagtggcaccgagtcggtgc

SEQ ID NO: 1315 - RNA, 106 nt, synthetic construct
  misc_feature 1..106: note = Synthetic
  source 1..106: mol_type = other RNA
cactgcaagctccacctcccgtttaagagctatgctggaaacagcatagcaagtttaaataaggctagtccgttatcaacttgaaaaagtggcaccgagtcggtgc

SEQ ID NO: 1316 - RNA, 106 nt, synthetic construct
  misc_feature 1..106: note = Synthetic
  source 1..106: mol_type = other RNA
tcactgcaagctccacctccgtttaagagctatgctggaaacagcatagcaagtttaaataaggctagtccgttatcaacttgaaaaagtggcaccgagtcggtgc

SEQ ID NO: 1317 - RNA, 106 nt, synthetic construct
  misc_feature 1..106: note = Synthetic
  source 1..106: mol_type = other RNA
cataccactgcactccagccgtttaagagctatgctggaaacagcatagcaagtttaaataaggctagtccgttatcaacttgaaaaagtggcaccgagtcggtgc

SEQ ID NO: 1318 - RNA, 106 nt, synthetic construct
  misc_feature 1..106: note = Synthetic
  source 1..106: mol_type = other RNA
ataccactgcactccagcctgtttaagagctatgctggaaacagcatagcaagtttaaataaggctagtccgttatcaacttgaaaaagtggcaccgagtcggtgc

SEQ ID NO: 1319 - RNA, 106 nt, synthetic construct
  misc_feature 1..106: note = Synthetic
  source 1..106: mol_type = other RNA
tcgcccaggctggagtgcaggtttaagagctatgctggaaacagcatagcaagtttaaataaggctagtccgttatcaacttgaaaaagtggcaccgagtcggtgc

SEQ ID NO: 1320 - RNA, 106 nt, synthetic construct
  misc_feature 1..106: note = Synthetic
  source 1..106: mol_type = other RNA
tctcactctttcgcccaggcgtttaagagctatgctggaaacagcatagcaagtttaaataaggctagtccgttatcaacttgaaaaagtggcaccgagtcggtgc

SEQ ID NO: 1321 - RNA, 106 nt, synthetic construct
  misc_feature 1..106: note = Synthetic
  source 1..106: mol_type = other RNA
ggagtctcactctttcgcccgtttaagagctatgctggaaacagcatagcaagtttaaataaggctagtccgttatcaacttgaaaaagtggcaccgagtcggtgc

SEQ ID NO: 1322 - RNA, 106 nt, synthetic construct
  misc_feature 1..106: note = Synthetic
  source 1..106: mol_type = other RNA
tgttttttgtttttttgagagtttaagagctatgctggaaacagcatagcaagtttaaataaggctagtccgttatcaacttgaaaaagtggcaccgagtcggtgc

SEQ ID NO: 1323 - RNA, 106 nt, synthetic construct
  misc_feature 1..106: note = Synthetic
  source 1..106: mol_type = other RNA
aggaagaaagaaaggtttttgtttaagagctatgctggaaacagcatagcaagtttaaataaggctagtccgttatcaacttgaaaaagtggcaccgagtcggtgc

SEQ ID NO: 1324 - RNA, 106 nt, synthetic construct
  misc_feature 1..106: note = Synthetic
  source 1..106: mol_type = other RNA
agaagaaaaggaagaaagaagtttaagagctatgctggaaacagcatagcaagtttaaataaggctagtccgttatcaacttgaaaaagtggcaccgagtcggtgc

SEQ ID NO: 1325 - RNA, 106 nt, synthetic construct
  misc_feature 1..106: note = Synthetic
  source 1..106: mol_type = other RNA
ctttcttccttttcttctctgtttaagagctatgctggaaacagcatagcaagtttaaataaggctagtccgttatcaacttgaaaaagtggcaccgagtcggtgc

SEQ ID NO: 1326 - RNA, 106 nt, synthetic construct
  misc_feature 1..106: note = Synthetic
  source 1..106: mol_type = other RNA
tttcttccttttcttctcttgtttaagagctatgctggaaacagcatagcaagtttaaataaggctagtccgttatcaacttgaaaaagtggcaccgagtcggtgc

SEQ ID NO: 1327 - RNA, 106 nt, synthetic construct
  misc_feature 1..106: note = Synthetic
  source 1..106: mol_type = other RNA
aatggacccaagagaagaaagtttaagagctatgctggaaacagcatagcaagtttaaataaggctagtccgttatcaacttgaaaaagtggcaccgagtcggtgc

SEQ ID NO: 1328 - RNA, 106 nt, synthetic construct
  misc_feature 1..106: note = Synthetic
  source 1..106: mol_type = other RNA
ggctattacataagaaacaagtttaagagctatgctggaaacagcatagcaagtttaaataaggctagtccgttatcaacttgaaaaagtggcaccgagtcggtgc

SEQ ID NO: 1329 - RNA, 106 nt, synthetic construct
  misc_feature 1..106: note = Synthetic
  source 1..106: mol_type = other RNA
cacaggaaaaggaactgtacgtttaagagctatgctggaaacagcatagcaagtttaaataaggctagtccgttatcaacttgaaaaagtggcaccgagtcggtgc

SEQ ID NO: 1330 - RNA, 106 nt, synthetic construct
  misc_feature 1..106: note = Synthetic
  source 1..106: mol_type = other RNA
attaaagctaacacaggaaagtttaagagctatgctggaaacagcatagcaagtttaaataaggctagtccgttatcaacttgaaaaagtggcaccgagtcggtgc

SEQ ID NO: 1331 - RNA, 106 nt, synthetic construct
  misc_feature 1..106: note = Synthetic
  source 1..106: mol_type = other RNA
tcaaaaattaaagctaacacgtttaagagctatgctggaaacagcatagcaagtttaaataaggctagtccgttatcaacttgaaaaagtggcaccgagtcggtgc

SEQ ID NO: 1332 - RNA, 106 nt, synthetic construct
  misc_feature 1..106: note = Synthetic
  source 1..106: mol_type = other RNA
taaaattgtctaaacatctcgtttaagagctatgctggaaacagcatagcaagtttaaataaggctagtccgttatcaacttgaaaaagtggcaccgagtcggtgc

SEQ ID NO: 1333 - RNA, 106 nt, synthetic construct
  misc_feature 1..106: note = Synthetic
  source 1..106: mol_type = other RNA
agagatgtttagacaattttgtttaagagctatgctggaaacagcatagcaagtttaaataaggctagtccgttatcaacttgaaaaagtggcaccgagtcggtgc

SEQ ID NO: 1334 - RNA, 106 nt, synthetic construct
  misc_feature 1..106: note = Synthetic
  source 1..106: mol_type = other RNA
tctaaacatctctgggaccagtttaagagctatgctggaaacagcatagcaagtttaaataaggctagtccgttatcaacttgaaaaagtggcaccgagtcggtgc

SEQ ID NO: 1335 - RNA, 106 nt, synthetic construct
  misc_feature 1..106: note = Synthetic
  source 1..106: mol_type = other RNA
tttatgctttcatatatcctgtttaagagctatgctggaaacagcatagcaagtttaaataaggctagtccgttatcaacttgaaaaagtggcaccgagtcggtgc

SEQ ID NO: 1336 - RNA, 106 nt, synthetic construct
  misc_feature 1..106: note = Synthetic
  source 1..106: mol_type = other RNA
agcataaattacaaagaaaagtttaagagctatgctggaaacagcatagcaagtttaaataaggctagtccgttatcaacttgaaaaagtggcaccgagtcggtgc

SEQ ID NO: 1337 - RNA, 106 nt, synthetic construct
  misc_feature 1..106: note = Synthetic
  source 1..106: mol_type = other RNA
tacaaagaaaaaggttatcagtttaagagctatgctggaaacagcatagcaagtttaaataaggctagtccgttatcaacttgaaaaagtggcaccgagtcggtgc

SEQ ID NO: 1338 - RNA, 106 nt, synthetic construct
  misc_feature 1..106: note = Synthetic
  source 1..106: mol_type = other RNA
acaaagaaaaaggttatcatgtttaagagctatgctggaaacagcatagcaagtttaaataaggctagtccgttatcaacttgaaaaagtggcaccgagtcggtgc

SEQ ID NO: 1339 - RNA, 106 nt, synthetic construct
  misc_feature 1..106: note = Synthetic
  source 1..106: mol_type = other RNA
caaagaaaaaggttatcatggtttaagagctatgctggaaacagcatagcaagtttaaataaggctagtccgttatcaacttgaaaaagtggcaccgagtcggtgc

SEQ ID NO: 1340 - RNA, 106 nt, synthetic construct
  misc_feature 1..106: note = Synthetic
  source 1..106: mol_type = other RNA
tctgagatttaaaatagagtgtttaagagctatgctggaaacagcatagcaagtttaaataaggctagtccgttatcaacttgaaaaagtggcaccgagtcggtgc

SEQ ID NO: 1341 - RNA, 106 nt, synthetic construct
  misc_feature 1..106: note = Synthetic
  source 1..106: mol_type = other RNA
cttataagatacattatgaagtttaagagctatgctggaaacagcatagcaagtttaaataaggctagtccgttatcaacttgaaaaagtggcaccgagtcggtgc

SEQ ID NO: 1342 - RNA, 106 nt, synthetic construct
  misc_feature 1..106: note = Synthetic
  source 1..106: mol_type = other RNA
tatcttataagactataaaagtttaagagctatgctggaaacagcatagcaagtttaaataaggctagtccgttatcaacttgaaaaagtggcaccgagtcggtgc

SEQ ID NO: 1343 - RNA, 106 nt, synthetic construct
  misc_feature 1..106: note = Synthetic
  source 1..106: mol_type = other RNA
atcttataagactataaaaagtttaagagctatgctggaaacagcatagcaagtttaaataaggctagtccgttatcaacttgaaaaagtggcaccgagtcggtgc

SEQ ID NO: 1344 - RNA, 106 nt, synthetic construct
  misc_feature 1..106: note = Synthetic
  source 1..106: mol_type = other RNA
ttataagactataaaaaggggtttaagagctatgctggaaacagcatagcaagtttaaataaggctagtccgttatcaacttgaaaaagtggcaccgagtcggtgc

SEQ ID NO: 1345 - RNA, 106 nt, synthetic construct
  misc_feature 1..106: note = Synthetic
  source 1..106: mol_type = other RNA
taaaaagggaggaaatataggtttaagagctatgctggaaacagcatagcaagtttaaataaggctagtccgttatcaacttgaaaaagtggcaccgagtcggtgc

SEQ ID NO: 1346 - RNA, 106 nt, synthetic construct
  misc_feature 1..106: note = Synthetic
  source 1..106: mol_type = other RNA
aaaaagggaggaaatatagagtttaagagctatgctggaaacagcatagcaagtttaaataaggctagtccgttatcaacttgaaaaagtggcaccgagtcggtgc

SEQ ID NO: 1347 - RNA, 106 nt, synthetic construct
  misc_feature 1..106: note = Synthetic
  source 1..106: mol_type = other RNA
aaatatagagggtccactttgtttaagagctatgctggaaacagcatagcaagtttaaataaggctagtccgttatcaacttgaaaaagtggcaccgagtcggtgc

SEQ ID NO: 1348 - RNA, 106 nt, synthetic construct
  misc_feature 1..106: note = Synthetic
  source 1..106: mol_type = other RNA
tatagagggtccacttttgggtttaagagctatgctggaaacagcatagcaagtttaaataaggctagtccgttatcaacttgaaaaagtggcaccgagtcggtgc

SEQ ID NO: 1349 - RNA, 106 nt, synthetic construct
  misc_feature 1..106: note = Synthetic
  source 1..106: mol_type = other RNA
actctgaagtccaccaaaaggtttaagagctatgctggaaacagcatagcaagtttaaataaggctagtccgttatcaacttgaaaaagtggcaccgagtcggtgc

SEQ ID NO: 1350 - RNA, 106 nt, synthetic construct
  misc_feature 1..106: note = Synthetic
  source 1..106: mol_type = other RNA
agaatagagttgcaccgtttgtttaagagctatgctggaaacagcatagcaagtttaaataaggctagtccgttatcaacttgaaaaagtggcaccgagtcggtgc

SEQ ID NO: 1351 - RNA, 106 nt, synthetic construct
  misc_feature 1..106: note = Synthetic
  source 1..106: mol_type = other RNA
aaaacggtgcaactctattcgtttaagagctatgctggaaacagcatagcaagtttaaataaggctagtccgttatcaacttgaaaaagtggcaccgagtcggtgc

SEQ ID NO: 1352 - RNA, 106 nt, synthetic construct
  misc_feature 1..106: note = Synthetic
  source 1..106: mol_type = other RNA
ccgttttgggctaatgaaaagtttaagagctatgctggaaacagcatagcaagtttaaataaggctagtccgttatcaacttgaaaaagtggcaccgagtcggtgc

SEQ ID NO: 1353 - RNA, 106 nt, synthetic construct
  misc_feature 1..106: note = Synthetic
  source 1..106: mol_type = other RNA
cctttttcattagcccaaaagtttaagagctatgctggaaacagcatagcaagtttaaataaggctagtccgttatcaacttgaaaaagtggcaccgagtcggtgc

SEQ ID NO: 1354 - RNA, 106 nt, synthetic construct
  misc_feature 1..106: note = Synthetic
  source 1..106: mol_type = other RNA
tgggctaatgaaaaaggaaggtttaagagctatgctggaaacagcatagcaagtttaaataaggctagtccgttatcaacttgaaaaagtggcaccgagtcggtgc

SEQ ID NO: 1355 - RNA, 106 nt, synthetic construct
  misc_feature 1..106: note = Synthetic
  source 1..106: mol_type = other RNA
taatgaaaaaggaagaggctgtttaagagctatgctggaaacagcatagcaagtttaaataaggctagtccgttatcaacttgaaaaagtggcaccgagtcggtgc

SEQ ID NO: 1356 - RNA, 106 nt, synthetic construct
  misc_feature 1..106: note = Synthetic
  source 1..106: mol_type = other RNA
aatgaaaaaggaagaggctagtttaagagctatgctggaaacagcatagcaagtttaaataaggctagtccgttatcaacttgaaaaagtggcaccgagtcggtgc

SEQ ID NO: 1357 - RNA, 106 nt, synthetic construct
  misc_feature 1..106: note = Synthetic
  source 1..106: mol_type = other RNA
ctgaatcttaaaatatgtccgtttaagagctatgctggaaacagcatagcaagtttaaataaggctagtccgttatcaacttgaaaaagtggcaccgagtcggtgc

SEQ ID NO: 1358 - RNA, 106 nt, synthetic construct
  misc_feature 1..106: note = Synthetic
  source 1..106: mol_type = other RNA
caggcagctttatctcaaccgtttaagagctatgctggaaacagcatagcaagtttaaataaggctagtccgttatcaacttgaaaaagtggcaccgagtcggtgc

SEQ ID NO: 1359 - RNA, 106 nt, synthetic construct
  misc_feature 1..106: note = Synthetic
  source 1..106: mol_type = other RNA
ctaagagatcaagtttcagcgtttaagagctatgctggaaacagcatagcaagtttaaataaggctagtccgttatcaacttgaaaaagtggcaccgagtcggtgc

SEQ ID NO: 1360 - RNA, 106 nt, synthetic construct
  misc_feature 1..106: note = Synthetic
  source 1..106: mol_type = other RNA
gtgttcttgttgatattctggtttaagagctatgctggaaacagcatagcaagtttaaataaggctagtccgttatcaacttgaaaaagtggcaccgagtcggtgc

SEQ ID NO: 1361 - RNA, 106 nt, synthetic construct
  misc_feature 1..106: note = Synthetic
  source 1..106: mol_type = other RNA
cttgttgatattctgtggcagtttaagagctatgctggaaacagcatagcaagtttaaataaggctagtccgttatcaacttgaaaaagtggcaccgagtcggtgc

SEQ ID NO: 1362 - RNA, 106 nt, synthetic construct
  misc_feature 1..106: note = Synthetic
  source 1..106: mol_type = other RNA
tctgtggcatggctacagatgtttaagagctatgctggaaacagcatagcaagtttaaataaggctagtccgttatcaacttgaaaaagtggcaccgagtcggtgc

SEQ ID NO: 1363 - RNA, 106 nt, synthetic construct
  misc_feature 1..106: note = Synthetic
  source 1..106: mol_type = other RNA
agaacttatttacacagggagtttaagagctatgctggaaacagcatagcaagtttaaataaggctagtccgttatcaacttgaaaaagtggcaccgagtcggtgc

SEQ ID NO: 1364 - RNA, 106 nt, synthetic construct
  misc_feature 1..106: note = Synthetic
  source 1..106: mol_type = other RNA
aaagagaacttatttacacagtttaagagctatgctggaaacagcatagcaagtttaaataaggctagtccgttatcaacttgaaaaagtggcaccgagtcggtgc

SEQ ID NO: 1365 - RNA, 106 nt, synthetic construct
  misc_feature 1..106: note = Synthetic
  source 1..106: mol_type = other RNA
caaagagaacttatttacacgtttaagagctatgctggaaacagcatagcaagtttaaataaggctagtccgttatcaacttgaaaaagtggcaccgagtcggtgc

SEQ ID NO: 1366 - RNA, 106 nt, synthetic construct
  misc_feature 1..106: note = Synthetic
  source 1..106: mol_type = other RNA
ttctctttgtatttacttttgtttaagagctatgctggaaacagcatagcaagtttaaataaggctagtccgttatcaacttgaaaaagtggcaccgagtcggtgc

SEQ ID NO: 1367 - RNA, 106 nt, synthetic construct
  misc_feature 1..106: note = Synthetic
  source 1..106: mol_type = other RNA
tctctttgtatttacttttagtttaagagctatgctggaaacagcatagcaagtttaaataaggctagtccgttatcaacttgaaaaagtggcaccgagtcggtgc

SEQ ID NO: 1368 - RNA, 106 nt, synthetic construct
  misc_feature 1..106: note = Synthetic
  source 1..106: mol_type = other RNA
ctttgtatttacttttaggggtttaagagctatgctggaaacagcatagcaagtttaaataaggctagtccgttatcaacttgaaaaagtggcaccgagtcggtgc

SEQ ID NO: 1369 - RNA, 106 nt, synthetic construct
  misc_feature 1..106: note = Synthetic
  source 1..106: mol_type = other RNA
agcttttgtccacctttaaagtttaagagctatgctggaaacagcatagcaagtttaaataaggctagtccgttatcaacttgaaaaagtggcaccgagtcggtgc

SEQ ID NO: 1370 - RNA, 106 nt, synthetic construct
  misc_feature 1..106: note = Synthetic
  source 1..106: mol_type = other RNA
tttatttttccatttaaagggtttaagagctatgctggaaacagcatagcaagtttaaataaggctagtccgttatcaacttgaaaaagtggcaccgagtcggtgc

SEQ ID NO: 1371 - RNA, 106 nt, synthetic construct
  misc_feature 1..106: note = Synthetic
  source 1..106: mol_type = other RNA
tattttatttttccatttaagtttaagagctatgctggaaacagcatagcaagtttaaataaggctagtccgttatcaacttgaaaaagtggcaccgagtcggtgc

SEQ ID NO: 1372 - RNA, 106 nt, synthetic construct
  misc_feature 1..106: note = Synthetic
  source 1..106: mol_type = other RNA
cttacataaacatacttaaagtttaagagctatgctggaaacagcatagcaagtttaaataaggctagtccgttatcaacttgaaaaagtggcaccgagtcggtgc

SEQ ID NO: 1373 - RNA, 106 nt, synthetic construct
  misc_feature 1..106: note = Synthetic
  source 1..106: mol_type = other RNA
taagcacagaagtttttaaggtttaagagctatgctggaaacagcatagcaagtttaaataaggctagtccgttatcaacttgaaaaagtggcaccgagtcggtgc

SEQ ID NO: 1374 - RNA, 106 nt, synthetic construct
  misc_feature 1..106: note = Synthetic
  source 1..106: mol_type = other RNA
aagtttttaagaggcatgaagtttaagagctatgctggaaacagcatagcaagtttaaataaggctagtccgttatcaacttgaaaaagtggcaccgagtcggtgc

SEQ ID NO: 1375 - RNA, 106 nt, synthetic construct
  misc_feature 1..106: note = Synthetic
  source 1..106: mol_type = other RNA
atatttacgtagtttttcatgtttaagagctatgctggaaacagcatagcaagtttaaataaggctagtccgttatcaacttgaaaaagtggcaccgagtcggtgc

SEQ ID NO: 1376 - RNA, 106 nt, synthetic construct
  misc_feature 1..106: note = Synthetic
  source 1..106: mol_type = other RNA
cgtaaatattcttgagaaacgtttaagagctatgctggaaacagcatagcaagtttaaataaggctagtccgttatcaacttgaaaaagtggcaccgagtcggtgc

SEQ ID NO: 1377 - RNA, 106 nt, synthetic construct
  misc_feature 1..106: note = Synthetic
  source 1..106: mol_type = other RNA
ttcttgagaaacaggaagacgtttaagagctatgctggaaacagcatagcaagtttaaataaggctagtccgttatcaacttgaaaaagtggcaccgagtcggtgc

SEQ ID NO: 1378 - RNA, 106 nt, synthetic construct
  misc_feature 1..106: note = Synthetic
  source 1..106: mol_type = other RNA
taatattaaaaacattggttgtttaagagctatgctggaaacagcatagcaagtttaaataaggctagtccgttatcaacttgaaaaagtggcaccgagtcggtgc

SEQ ID NO: 1379 - RNA, 106 nt, synthetic construct
  misc_feature 1..106: note = Synthetic
  source 1..106: mol_type = other RNA
ccaatgtttttaatattatcgtttaagagctatgctggaaacagcatagcaagtttaaataaggctagtccgttatcaacttgaaaaagtggcaccgagtcggtgc

SEQ ID NO: 1380 - RNA, 106 nt, synthetic construct
  misc_feature 1..106: note = Synthetic
  source 1..106: mol_type = other RNA
cctgataatattaaaaacatgtttaagagctatgctggaaacagcatagcaagtttaaataaggctagtccgttatcaacttgaaaaagtggcaccgagtcggtgc

SEQ ID NO: 1381 - RNA, 106 nt, synthetic construct
  misc_feature 1..106: note = Synthetic
  source 1..106: mol_type = other RNA
cattatcatgcatacatctcgtttaagagctatgctggaaacagcatagcaagtttaaataaggctagtccgttatcaacttgaaaaagtggcaccgagtcggtgc

SEQ ID NO: 1382 - RNA, 106 nt, synthetic construct
  misc_feature 1..106: note = Synthetic
  source 1..106: mol_type = other RNA
atcatgcatacatctctggcgtttaagagctatgctggaaacagcatagcaagtttaaataaggctagtccgttatcaacttgaaaaagtggcaccgagtcggtgc

SEQ ID NO: 1383 - RNA, 106 nt, synthetic construct
  misc_feature 1..106: note = Synthetic
  source 1..106: mol_type = other RNA
ttcatttcattttgattttggtttaagagctatgctggaaacagcatagcaagtttaaataaggctagtccgttatcaacttgaaaaagtggcaccgagtcggtgc

SEQ ID NO: 1384 - RNA, 106 nt, synthetic construct
  misc_feature 1..106: note = Synthetic
  source 1..106: mol_type = other RNA
attcaatttgaagcagtggtgtttaagagctatgctggaaacagcatagcaagtttaaataaggctagtccgttatcaacttgaaaaagtggcaccgagtcggtgc

SEQ ID NO: 1385 - RNA, 106 nt, synthetic construct
  misc_feature 1..106: note = Synthetic
  source 1..106: mol_type = other RNA
gaatattcaatttgaagcaggtttaagagctatgctggaaacagcatagcaagtttaaataaggctagtccgttatcaacttgaaaaagtggcaccgagtcggtgc

SEQ ID NO: 1386 - RNA, 106 nt, synthetic construct
  misc_feature 1..106: note = Synthetic
  source 1..106: mol_type = other RNA
catacgatttaaaatcgctggtttaagagctatgctggaaacagcatagcaagtttaaataaggctagtccgttatcaacttgaaaaagtggcaccgagtcggtgc

SEQ ID NO: 1387 - RNA, 106 nt, synthetic construct
  misc_feature 1..106: note = Synthetic
  source 1..106: mol_type = other RNA
aaaatcgctgaggcgcgttcgtttaagagctatgctggaaacagcatagcaagtttaaataaggctagtccgttatcaacttgaaaaagtggcaccgagtcggtgc

SEQ ID NO: 1388 - RNA, 106 nt, synthetic construct
  misc_feature 1..106: note = Synthetic
  source 1..106: mol_type = other RNA
tttttttttcttttttgtacgtttaagagctatgctggaaacagcatagcaagtttaaataaggctagtccgttatcaacttgaaaaagtggcaccgagtcggtgc

SEQ ID NO: 1389 - RNA, 106 nt, synthetic construct
  misc_feature 1..106: note = Synthetic
  source 1..106: mol_type = other RNA
ctgttgtcaaagattttaaagtttaagagctatgctggaaacagcatagcaagtttaaataaggctagtccgttatcaacttgaaaaagtggcaccgagtcggtgc

SEQ ID NO: 1390 - RNA, 106 nt, synthetic construct
  misc_feature 1..106: note = Synthetic
  source 1..106: mol_type = other RNA
tgacaacagagttctgttttgtttaagagctatgctggaaacagcatagcaagtttaaataaggctagtccgttatcaacttgaaaaagtggcaccgagtcggtgc

SEQ ID NO: 1391 - RNA, 106 nt, synthetic construct
  misc_feature 1..106: note = Synthetic
  source 1..106: mol_type = other RNA
agaatacgctgagagttatcgtttaagagctatgctggaaacagcatagcaagtttaaataaggctagtccgttatcaacttgaaaaagtggcaccgagtcggtgc

SEQ ID NO: 1392 - RNA, 106 nt, synthetic construct
  misc_feature 1..106: note = Synthetic
  source 1..106: mol_type = other RNA
gcaagagaagaaaagaacgggtttaagagctatgctggaaacagcatagcaagtttaaataaggctagtccgttatcaacttgaaaaagtggcaccgagtcggtgc

SEQ ID NO: 1393 - RNA, 106 nt, synthetic construct
  misc_feature 1..106: note = Synthetic
  source 1..106: mol_type = other RNA
gttgcaagagaagaaaagaagtttaagagctatgctggaaacagcatagcaagtttaaataaggctagtccgttatcaacttgaaaaagtggcaccgagtcggtgc

SEQ ID NO: 1394 - RNA, 106 nt, synthetic construct
  misc_feature 1..106: note = Synthetic
  source 1..106: mol_type = other RNA
atgcacacgtaaaagagagggtttaagagctatgctggaaacagcatagcaagtttaaataaggctagtccgttatcaacttgaaaaagtggcaccgagtcggtgc

SEQ ID NO: 1395 - RNA, 106 nt, synthetic construct
  misc_feature 1..106: note = Synthetic
  source 1..106: mol_type = other RNA
aagatgcacacgtaaaagaggtttaagagctatgctggaaacagcatagcaagtttaaataaggctagtccgttatcaacttgaaaaagtggcaccgagtcggtgc

SEQ ID NO: 1396 - RNA, 106 nt, synthetic construct; identical to SEQ ID NO: 1382
  misc_feature 1..106: note = Synthetic
  source 1..106: mol_type = other RNA

SEQ ID NO: 1397 - RNA, 106 nt, synthetic construct; identical to SEQ ID NO: 1383
  misc_feature 1..106: note = Synthetic
  source 1..106: mol_type = other RNA

SEQ ID NO: 1398 - RNA, 106 nt, synthetic construct; identical to SEQ ID NO: 1384
  misc_feature 1..106: note = Synthetic
  source 1..106: mol_type = other RNA

SEQ ID NO: 1399 - RNA, 106 nt, synthetic construct; identical to SEQ ID NO: 1385
  misc_feature 1..106: note = Synthetic
  source 1..106: mol_type = other RNA

SEQ ID NO: 1400 - RNA, 106 nt, synthetic construct; identical to SEQ ID NO: 1386
  misc_feature 1..106: note = Synthetic
  source 1..106: mol_type = other RNA

SEQ ID NO: 1401 - RNA, 106 nt, synthetic construct; identical to SEQ ID NO: 1387
  misc_feature 1..106: note = Synthetic
  source 1..106: mol_type = other RNA

SEQ ID NO: 1402 - RNA, 106 nt, synthetic construct; identical to SEQ ID NO: 1388
  misc_feature 1..106: note = Synthetic
  source 1..106: mol_type = other RNA

SEQ ID NO: 1403 - RNA, 106 nt, synthetic construct; identical to SEQ ID NO: 1389
  misc_feature 1..106: note = Synthetic
  source 1..106: mol_type = other RNA

SEQ ID NO: 1404 - RNA, 106 nt, synthetic construct; identical to SEQ ID NO: 1390
  misc_feature 1..106: note = Synthetic
  source 1..106: mol_type = other RNA

SEQ ID NO: 1405 - RNA, 106 nt, synthetic construct; identical to SEQ ID NO: 1391
  misc_feature 1..106: note = Synthetic
  source 1..106: mol_type = other RNA

SEQ ID NO: 1406 - RNA, 106 nt, synthetic construct; identical to SEQ ID NO: 1392
  misc_feature 1..106: note = Synthetic
  source 1..106: mol_type = other RNA

SEQ ID NO: 1407 - RNA, 106 nt, synthetic construct; identical to SEQ ID NO: 1393
  misc_feature 1..106: note = Synthetic
  source 1..106: mol_type = other RNA

SEQ ID NO: 1408 - RNA, 106 nt, synthetic construct; identical to SEQ ID NO: 1394
  misc_feature 1..106: note = Synthetic
  source 1..106: mol_type = other RNA

SEQ ID NO: 1409 - RNA, 106 nt, synthetic construct; identical to SEQ ID NO: 1395
  misc_feature 1..106: note = Synthetic
  source 1..106: mol_type = other RNA

SEQ ID NO: 1410 - RNA, 106 nt, synthetic construct
  misc_feature 1..106: note = Synthetic
  source 1..106: mol_type = other RNA
ggcagaccgttctcatcacggtttaagagctatgctggaaacagcatagcaagtttaaataaggctagtccgttatcaacttgaaaaagtggcaccgagtcggtgc

SEQ ID NO: 1411 - RNA, 106 nt, synthetic construct
  misc_feature 1..106: note = Synthetic
  source 1..106: mol_type = other RNA
ctttaccagtgactccaggtgtttaagagctatgctggaaacagcatagcaagtttaaataaggctagtccgttatcaacttgaaaaagtggcaccgagtcggtgc

SEQ ID NO: 1412 - RNA, 106 nt, synthetic construct
  misc_feature 1..106: note = Synthetic
  source 1..106: mol_type = other RNA
gtcacagatttccttctccggtttaagagctatgctggaaacagcatagcaagtttaaataaggctagtccgttatcaacttgaaaaagtggcaccgagtcggtgc

SEQ ID NO: 1413 - RNA, 106 nt, synthetic construct
  misc_feature 1..106: note = Synthetic
  source 1..106: mol_type = other RNA
agatgatgacgcccaccagagtttaagagctatgctggaaacagcatagcaagtttaaataaggctagtccgttatcaacttgaaaaagtggcaccgagtcggtgc

SEQ ID NO: 1414 - RNA, 106 nt, synthetic construct
  misc_feature 1..106: note = Synthetic
  source 1..106: mol_type = other RNA
ggagaaggaaatctgtgaccgtttaagagctatgctggaaacagcatagcaagtttaaataaggctagtccgttatcaacttgaaaaagtggcaccgagtcggtgc

SEQ ID NO: 1415 - RNA, 106 nt, synthetic construct
  misc_feature 1..106: note = Synthetic
  source 1..106: mol_type = other RNA
tgcgaggaacttacttttccgtttaagagctatgctggaaacagcatagcaagtttaaataaggctagtccgttatcaacttgaaaaagtggcaccgagtcggtgc

SEQ ID NO: 1416 - RNA, 106 nt, synthetic construct
  misc_feature 1..106: note = Synthetic
  source 1..106: mol_type = other RNA
agagaaatattgatataggagtttaagagctatgctggaaacagcatagcaagtttaaataaggctagtccgttatcaacttgaaaaagtggcaccgagtcggtgc

SEQ ID NO: 1417 - RNA, 106 nt, synthetic construct
  misc_feature 1..106: note = Synthetic
  source 1..106: mol_type = other RNA
tatcaatatttctctgatccgtttaagagctatgctggaaacagcatagcaagtttaaataaggctagtccgttatcaacttgaaaaagtggcaccgagtcggtgc

SEQ ID NO: 1418 - RNA, 106 nt, synthetic construct
  misc_feature 1..106: note = Synthetic
  source 1..106: mol_type = other RNA
atcgcttttaaggcacgctcgtttaagagctatgctggaaacagcatagcaagtttaaataaggctagtccgttatcaacttgaaaaagtggcaccgagtcggtgc

SEQ ID NO: 1419 - RNA, 106 nt, synthetic construct
  misc_feature 1..106: note = Synthetic
  source 1..106: mol_type = other RNA
tatacgactgatcgcttttagtttaagagctatgctggaaacagcatagcaagtttaaataaggctagtccgttatcaacttgaaaaagtggcaccgagtcggtgc

SEQ ID NO: 1420 - RNA, 77 nt, synthetic construct
  misc_feature 1..77: note = Synthetic
  source 1..77: mol_type = other RNA
gttttagagctagaaatagcaagttaaaataaggctagtccgttatcaacttgaaaaagtggcaccgagtcggtgct

SEQ ID NO: 1421 - RNA, 16 nt, synthetic construct
  misc_feature 1..16: note = Synthetic
  source 1..16: mol_type = other RNA
gttttagagctatgct

SEQ ID NO: 1422 - RNA, 67 nt, synthetic construct
  misc_feature 1..67: note = Synthetic
  source 1..67: mol_type = other RNA
agcatagcaagttaaaataaggctagtccgttatcaacttgaaaaagtggcaccgagtcggtgcttt

SEQ ID NO: 1423 - RNA, 20 nt, synthetic construct
  misc_feature 1..20: note = Synthetic
  source 1..20: mol_type = other RNA
tgtcaggttagttagatgaa

SEQ ID NO: 1424 - RNA, 20 nt, synthetic construct
  misc_feature 1..20: note = Synthetic
  source 1..20: mol_type = other RNA
gtgtcaggttagttagatga

SEQ ID NO: 1425 - RNA, 20 nt, synthetic construct
  misc_feature 1..20: note = Synthetic
  source 1..20: mol_type = other RNA
cctgacacatatacagacta

SEQ ID NO: 1426 - RNA, 20 nt, synthetic construct
  misc_feature 1..20: note = Synthetic
  source 1..20: mol_type = other RNA
ctgacacatatacagactaa

SEQ ID NO: 1427 - RNA, 20 nt, synthetic construct
  misc_feature 1..20: note = Synthetic
  source 1..20: mol_type = other RNA
ccttagtctgtatatgtgtc

SEQ ID NO: 1428 - RNA, 20 nt, synthetic construct
  misc_feature 1..20: note = Synthetic
  source 1..20: mol_type = other RNA
catatacagactaagggacc

SEQ ID NO: 1429 - RNA, 20 nt, synthetic construct
  misc_feature 1..20: note = Synthetic
  source 1..20: mol_type = other RNA
atatacagactaagggacca

SEQ ID NO: 1430 - RNA, 20 nt, synthetic construct
  misc_feature 1..20: note = Synthetic
  source 1..20: mol_type = other RNA
tcaaagtttgataaattccc

SEQ ID NO: 1431 - RNA, 20 nt, synthetic construct
  misc_feature 1..20: note = Synthetic
  source 1..20: mol_type = other RNA
aaaatacaaagataagtaga

SEQ ID NO: 1432 - RNA, 20 nt, synthetic construct
  misc_feature 1..20: note = Synthetic
  source 1..20: mol_type = other RNA
actctgtgactttaaaaagt

SEQ ID NO: 1433 - RNA, 20 nt, synthetic construct
  misc_feature 1..20: note = Synthetic
  source 1..20: mol_type = other RNA
ggttctgtgggatattaata

SEQ ID NO: 1434 - RNA, 20 nt, synthetic construct
  misc_feature 1..20: note = Synthetic
  source 1..20: mol_type = other RNA
acagagcatattggttctgt

SEQ ID NO: 1435 - RNA, 20 nt, synthetic construct
  misc_feature 1..20: note = Synthetic
  source 1..20: mol_type = other RNA
gacagagcatattggttctg

SEQ ID NO: 1436 - RNA, 20 nt, synthetic construct
  misc_feature 1..20: note = Synthetic
  source 1..20: mol_type = other RNA
tgcaaaacgacagagcatat

SEQ ID NO: 1437 - RNA, 20 nt, synthetic construct
  misc_feature 1..20: note = Synthetic
  source 1..20: mol_type = other RNA
gagctgggcatggaataggc

SEQ ID NO: 1438 - RNA, 20 nt, synthetic construct
  misc_feature 1..20: note = Synthetic
  source 1..20: mol_type = other RNA
actggagctgggcatggaat

SEQ ID NO: 1439 - RNA, 20 nt, synthetic construct
  misc_feature 1..20: note = Synthetic
  source 1..20: mol_type = other RNA
ctcattactggagctgggca

SEQ ID NO: 1440 - RNA, 20 nt, synthetic construct
  misc_feature 1..20: note = Synthetic
  source 1..20: mol_type = other RNA
ttgttctcattactggagct

SEQ ID NO: 1441 - RNA, 20 nt, synthetic construct
  misc_feature 1..20: note = Synthetic
  source 1..20: mol_type = other RNA
attgttctcattactggagc

SEQ ID NO: 1442 - RNA, 20 nt, synthetic construct
  misc_feature 1..20: note = Synthetic
  source 1..20: mol_type = other RNA
ggggagattgttctcattac

SEQ ID NO: 1443 - RNA, 20 nt, synthetic construct
  misc_feature 1..20: note = Synthetic
  source 1..20: mol_type = other RNA
gaggagaaaatctgtggctg

SEQ ID NO: 1444 - RNA, 20 nt, synthetic construct
  misc_feature 1..20: note = Synthetic
  source 1..20: mol_type = other RNA
agaggagaaaatctgtggct

SEQ ID NO: 1445 - RNA, 20 nt, synthetic construct
  misc_feature 1..20: note = Synthetic
  source 1..20: mol_type = other RNA
cagaggagaaaatctgtggc

SEQ ID NO: 1446 - RNA, 20 nt, synthetic construct
  misc_feature 1..20: note = Synthetic
  source 1..20: mol_type = other RNA
tcctcagaggagaaaatctg

SEQ ID NO: 1447 - RNA, 20 nt, synthetic construct
  misc_feature 1..20: note = Synthetic
  source 1..20: mol_type = other RNA
tgaagtttttcattcctcag

SEQ ID NO: 1448 - RNA, 20 nt, synthetic construct
  misc_feature 1..20: note = Synthetic
  source 1..20: mol_type = other RNA
cttcaccaacgactccaagt

SEQ ID NO: 1449 - RNA, 20 nt, synthetic construct
  misc_feature 1..20: note = Synthetic
  source 1..20: mol_type = other RNA
ctactcctacttggagtcgt

SEQ ID NO: 1450 - RNA, 20 nt, synthetic construct
  misc_feature 1..20: note = Synthetic
  source 1..20: mol_type = other RNA
ctccaagtaggagtagatga

SEQ ID NO: 1451 - RNA, 20 nt, synthetic construct
  misc_feature 1..20: note = Synthetic
  source 1..20: mol_type = other RNA
caccatcatctactcctact

SEQ ID NO: 1452 - RNA, 20 nt, synthetic construct
  misc_feature 1..20: note = Synthetic
  source 1..20: mol_type = other RNA
tgatggtgatcagaagcaga

SEQ ID NO: 1453 - RNA, 20 nt, synthetic construct
  misc_feature 1..20: note = Synthetic
  source 1..20: mol_type = other RNA
tcagaagcagaaggatttct

SEQ ID NO: 1454 - RNA, 20 nt, synthetic construct
  misc_feature 1..20: note = Synthetic
  source 1..20: mol_type = other RNA
gatttctaggatgatgttca

SEQ ID NO: 1455 - RNA, 20 nt, synthetic construct
  misc_feature 1..20: note = Synthetic
  source 1..20: mol_type = other RNA
ttgctctgtcctcttccttc

SEQ ID NO: 1456 - RNA, 20 nt, synthetic construct
  misc_feature 1..20: note = Synthetic
  source 1..20: mol_type = other RNA
aggactgaaccagaaggaag

SEQ ID NO: 1457 - RNA, 20 nt, synthetic construct
  misc_feature 1..20: note = Synthetic
  source 1..20: mol_type = other RNA
tacacaaggactgaaccaga

SEQ ID NO: 1458 - RNA, 20 nt, synthetic construct
  misc_feature 1..20: note = Synthetic
  source 1..20: mol_type = other RNA
ttcagtccttgtgtagtcct

SEQ ID NO: 1459 - RNA, 20 nt, synthetic construct
  misc_feature 1..20: note = Synthetic
  source 1..20: mol_type = other RNA
tcagtccttgtgtagtccta

SEQ ID NO: 1460 - RNA, 20 nt, synthetic construct
  misc_feature 1..20: note = Synthetic
  source 1..20: mol_type = other RNA
gtccttgtgtagtcctaggg

SEQ ID NO: 1461 - RNA, 20 nt, synthetic construct
  misc_feature 1..20: note = Synthetic
  source 1..20: mol_type = other RNA
cttgtgtagtcctagggagg

SEQ ID NO: 1462 - RNA, 20 nt, synthetic construct
  misc_feature 1..20: note = Synthetic
  source 1..20: mol_type = other RNA
ctcctccctaggactacaca

SEQ ID NO: 1463 - RNA, 20 nt, synthetic construct
  misc_feature 1..20: note = Synthetic
  source 1..20: mol_type = other RNA
gtagacagtacctcctccct

SEQ ID NO: 1464 - RNA, 20 nt, synthetic construct
  misc_feature 1..20: note = Synthetic
  source 1..20: mol_type = other RNA
tactgtctacacagagctct

SEQ ID NO: 1465 - RNA, 20 nt, synthetic construct
  misc_feature 1..20: note = Synthetic
  source 1..20: mol_type = other RNA
actgtctacacagagctcta

SEQ ID NO: 1466 - RNA, 20 nt, synthetic construct
  misc_feature 1..20: note = Synthetic
  source 1..20: mol_type = other RNA
tctacacagagctctaggga

SEQ ID NO: 1467 - RNA, 20 nt, synthetic construct
  misc_feature 1..20: note = Synthetic
  source 1..20: mol_type = other RNA
ctacacagagctctagggaa

SEQ ID NO: 1468 - RNA, 20 nt, synthetic construct
  misc_feature 1..20: note = Synthetic
  source 1..20: mol_type = other RNA
tacacagagctctagggaag

SEQ ID NO: 1469 - RNA, 20 nt, synthetic construct
  misc_feature 1..20: note = Synthetic
  source 1..20: mol_type = other RNA
ggggtgtgcccagttgttaa

SEQ ID NO: 1470 - RNA, 20 nt, synthetic construct
  misc_feature 1..20: note = Synthetic
  source 1..20: mol_type = other RNA
gggtgtgcccagttgttaat

SEQ ID NO: 1471 - RNA, 20 nt, synthetic construct
  misc_feature 1..20: note = Synthetic
  source 1..20: mol_type = other RNA
tggtagtcccattaacaact

SEQ ID NO: 1472 - RNA, 20 nt, synthetic construct
  misc_feature 1..20: note = Synthetic
  source 1..20: mol_type = other RNA
ctggtagtcccattaacaac

SEQ ID NO: 1473 - RNA, 20 nt, synthetic construct
  misc_feature 1..20: note = Synthetic
  source 1..20: mol_type = other RNA
ttgttaatgggactaccaga

SEQ ID NO: 1474 - RNA, 20 nt, synthetic construct
  misc_feature 1..20: note = Synthetic
  source 1..20: mol_type = other RNA
taccagatggaagccagctt

SEQ ID NO: 1475 - RNA, 20 nt, synthetic construct
  misc_feature 1..20: note = Synthetic
  source 1..20: mol_type = other RNA
ttccaaagctggcttccatc

SEQ ID NO: 1476 - RNA, 20 nt, synthetic construct
  misc_feature 1..20: note = Synthetic
  source 1..20: mol_type = other RNA
tggaagccagctttggaagc

SEQ ID NO: 1477 - RNA, 20 nt, synthetic construct
  misc_feature 1..20: note = Synthetic
  source 1..20: mol_type = other RNA
acaaggcctgcttccaaagc

SEQ ID NO: 1478 - RNA, 20 nt, synthetic construct
  misc_feature 1..20: note = Synthetic
  source 1..20: mol_type = other RNA
gccttgttcacgtgttctaa

SEQ ID NO: 1479 - RNA, 20 nt, synthetic construct
  misc_feature 1..20: note = Synthetic
  source 1..20: mol_type = other RNA
ccttgttcacgtgttctaat

SEQ ID NO: 1480 - RNA, 20 nt, synthetic construct
  misc_feature 1..20: note = Synthetic
  source 1..20: mol_type = other RNA
cccattagaacacgtgaaca

SEQ ID NO: 1481 - RNA, 20 nt, synthetic construct
  misc_feature 1..20: note = Synthetic
  source 1..20: mol_type = other RNA
ttggcatcacttcatatttg

SEQ ID NO: 1482 - RNA, 20 nt, synthetic construct
  misc_feature 1..20: note = Synthetic
  source 1..20: mol_type = other RNA
cttgtgctcttggcatcact

SEQ ID NO: 1483 - RNA, 20 nt, synthetic construct
  misc_feature 1..20: note = Synthetic
  source 1..20: mol_type = other RNA
agcacactctcttgtgctct

SEQ ID NO: 1484 - RNA, 20 nt, synthetic construct
  misc_feature 1..20: note = Synthetic
  source 1..20: mol_type = other RNA
gcacaagagagtgtgctctc

SEQ ID NO: 1485 - RNA, 20 nt, synthetic construct
  misc_feature 1..20: note = Synthetic
  source 1..20: mol_type = other RNA
gcttaatctcacacatagaa

SEQ ID NO: 1486 - RNA, 20 nt, synthetic construct
  misc_feature 1..20: note = Synthetic
  source 1..20: mol_type = other RNA
cttaatctcacacatagaaa

SEQ ID NO: 1487 - RNA, 20 nt, synthetic construct
  misc_feature 1..20: note = Synthetic
  source 1..20: mol_type = other RNA
ttaatctcacacatagaaag

SEQ ID NO: 1488 - RNA, 20 nt, synthetic construct
  misc_feature 1..20: note = Synthetic
  source 1..20: mol_type = other RNA
aggagtgctggtttatcaac

SEQ ID NO: 1489 - RNA, 20 nt, synthetic construct
  misc_feature 1..20: note = Synthetic
  source 1..20: mol_type = other RNA
ttctttgacagcaggagtgc

SEQ ID NO: 1490 - RNA, 20 nt, synthetic construct
  misc_feature 1..20: note = Synthetic
  source 1..20: mol_type = other RNA
actctggtttctttgacagc

SEQ ID NO: 1491 - RNA, 20 nt, synthetic construct
  misc_feature 1..20: note = Synthetic
  source 1..20: mol_type = other RNA
accagagttgagaaaacccc

SEQ ID NO: 1492 - RNA, 20 nt, synthetic construct
  misc_feature 1..20: note = Synthetic
  source 1..20: mol_type = other RNA
tccaggggttttctcaactc

SEQ ID NO: 1493 - RNA, 20 nt, synthetic construct
  misc_feature 1..20: note = Synthetic
  source 1..20: mol_type = other RNA
cagttattaaatgaatccag

SEQ ID NO: 1494 - RNA, 20 nt, synthetic construct
  misc_feature 1..20: note = Synthetic
  source 1..20: mol_type = other RNA
gcagttattaaatgaatcca

SEQ ID NO: 1495 - RNA, 20 nt, synthetic construct
  misc_feature 1..20: note = Synthetic
  source 1..20: mol_type = other RNA
ggcagttattaaatgaatcc

SEQ ID NO: 1496 - RNA, 20 nt, synthetic construct
  misc_feature 1..20: note = Synthetic
  source 1..20: mol_type = other RNA
tggatggtaacagctacatc

SEQ ID NO: 1497 - RNA, 20 nt, synthetic construct
  misc_feature 1..20: note = Synthetic
  source 1..20: mol_type = other RNA
gctgttaccatccacatcct

SEQ ID NO: 1498 - RNA, 20 nt, synthetic construct
  misc_feature 1..20: note = Synthetic
  source 1..20: mol_type = other RNA
tcaagaaccaaggatgtgga

SEQ ID NO: 1499 - RNA, 20 nt, synthetic construct
  misc_feature 1..20: note = Synthetic
  source 1..20: mol_type = other RNA
tccttcaagaaccaaggatg

SEQ ID NO: 1500 - RNA, 20 nt, synthetic construct
  misc_feature 1..20: note = Synthetic
  source 1..20: mol_type = other RNA
tgagtgtccttcaagaacca

SEQ ID NO: 1501 - RNA, 20 nt, synthetic construct
  misc_feature 1..20: note = Synthetic
  source 1..20: mol_type = other RNA
ttttattttataactacaag

SEQ ID NO: 1502 - RNA, 20 nt, synthetic construct
  misc_feature 1..20: note = Synthetic
  source 1..20: mol_type = other RNA
ttgtttttaataaaaacaag

SEQ ID NO: 1503 - RNA, 20 nt, synthetic construct
  misc_feature 1..20: note = Synthetic
  source 1..20: mol_type = other RNA
tattatagaatgcttttgca

SEQ ID NO: 1504 - RNA, 20 nt, synthetic construct
  misc_feature 1..20: note = Synthetic
  source 1..20: mol_type = other RNA
caagattagtcttgatgtag

SEQ ID NO: 1505 - RNA, 20 nt, synthetic construct
  misc_feature 1..20: note = Synthetic
  source 1..20: mol_type = other RNA
aagattagtcttgatgtagt

SEQ ID NO: 1506 - RNA, 20 nt, synthetic construct
  misc_feature 1..20: note = Synthetic
  source 1..20: mol_type = other RNA
agtcttgatgtagtgggagt

SEQ ID NO: 1507 - RNA, 20 nt, synthetic construct
  misc_feature 1..20: note = Synthetic
  source 1..20: mol_type = other RNA
tttttctattaaaaaaaaaa

SEQ ID NO: 1508 - RNA, 20 nt, synthetic construct
  misc_feature 1..20: note = Synthetic
  source 1..20: mol_type = other RNA
tctattaaaaaaaaaaaggc

SEQ ID NO: 1509 - RNA, 20 nt, synthetic construct
  misc_feature 1..20: note = Synthetic
  source 1..20: mol_type = other RNA
ctattaaaaaaaaaaaggct

SEQ ID NO: 1510 - RNA, 20 nt, synthetic construct
  misc_feature 1..20: note = Synthetic
  source 1..20: mol_type = other RNA
aaaaaaaaaaaggctgggca

SEQ ID NO: 1511 - RNA, 20 nt, synthetic construct
  misc_feature 1..20: note = Synthetic
  source 1..20: mol_type = other RNA
aaaaaaaaggctgggcacgg

SEQ ID NO: 1512 - RNA, 20 nt, synthetic construct
  misc_feature 1..20: note = Synthetic
  source 1..20: mol_type = other RNA
cacccgtaatcccagcactt

SEQ ID NO: 1513 - RNA, 20 nt, synthetic construct
  misc_feature 1..20: note = Synthetic
  source 1..20: mol_type = other RNA
acccgtaatcccagcacttt

SEQ ID NO: 1514 - RNA, 20 nt, synthetic construct
  misc_feature 1..20: note = Synthetic
  source 1..20: mol_type = other RNA
cgtaatcccagcactttggg

SEQ ID NO: 1515 - RNA, 20 nt, synthetic construct
  misc_feature 1..20: note = Synthetic
  source 1..20: mol_type = other RNA
tcccaaagtgctgggattac

SEQ ID NO: 1516 - RNA, 20 nt, synthetic construct
  misc_feature 1..20: note = Synthetic
  source 1..20: mol_type = other RNA
ctcccaaagtgctgggatta

SEQ ID NO: 1517 - RNA, 20 nt, synthetic construct
  misc_feature 1..20: note = Synthetic
  source 1..20: mol_type = other RNA
cccagcactttgggaggccg

SEQ ID NO: 1518 - RNA, 20 nt, synthetic construct
  misc_feature 1..20: note = Synthetic
  source 1..20: mol_type = other RNA
cctcggcctcccaaagtgct

SEQ ID NO: 1519 - RNA, 20 nt, synthetic construct
  misc_feature 1..20: note = Synthetic
  source 1..20: mol_type = other RNA
gcactttgggaggccgaggc

SEQ ID NO: 1520 - RNA, 20 nt, synthetic construct
  misc_feature 1..20: note = Synthetic
  source 1..20: mol_type = other RNA
ctttgggaggccgaggcagg

SEQ ID NO: 1521 - RNA, 20 nt, synthetic construct
  misc_feature 1..20: note = Synthetic
  source 1..20: mol_type = other RNA
gccgaggcaggtggatcacg

SEQ ID NO: 1522 - RNA, 20 nt, synthetic construct
  misc_feature 1..20: note = Synthetic
  source 1..20: mol_type = other RNA
acctcgtgatccacctgcct

SEQ ID NO: 1523 - RNA, 20 nt, synthetic construct
  misc_feature 1..20: note = Synthetic
  source 1..20: mol_type = other RNA
ggcaggtggatcacgaggtc

SEQ ID NO: 1524 - RNA, 20 nt, synthetic construct
  misc_feature 1..20: note = Synthetic
  source 1..20: mol_type = other RNA
tcaggagatcgagaccatct

SEQ ID NO: 1525 - RNA, 20 nt, synthetic construct
  misc_feature 1..20: note = Synthetic
  source 1..20: mol_type = other RNA
cgagaccatcttggctaaca

SEQ ID NO: 1526 - RNA, 20 nt, synthetic construct
  misc_feature 1..20: note = Synthetic
  source 1..20: mol_type = other RNA
tttcaccatgttagccaaga

SEQ ID NO: 1527 - RNA, 20 nt, synthetic construct
  misc_feature 1..20: note = Synthetic
  source 1..20: mol_type = other RNA
ttgtattttttgtagagacg

SEQ ID NO: 1528 - RNA, 20 nt, synthetic construct
  misc_feature 1..20: note = Synthetic
  source 1..20: mol_type = other RNA
tttgtattttttgtagagac

SEQ ID NO: 1529 - RNA, 20 nt, synthetic construct
  misc_feature 1..20: note = Synthetic
  source 1..20: mol_type = other RNA
ttttgtattttttgtagaga

SEQ ID NO: 1530 - RNA, 20 nt, synthetic construct
  misc_feature 1..20: note = Synthetic
  source 1..20: mol_type = other RNA
aaaaaatacaaaaaattagc

SEQ ID NO: 1531 - RNA, 20 nt, synthetic construct
  misc_feature 1..20: note = Synthetic
  source 1..20: mol_type = other RNA
aaaaatacaaaaaattagcc

SEQ ID NO: 1532 - RNA, 20 nt, synthetic construct
  misc_feature 1..20: note = Synthetic
  source 1..20: mol_type = other RNA
tacaaaaaattagccgggtg

SEQ ID NO: 1533 - RNA, 20 nt, synthetic construct
  misc_feature 1..20: note = Synthetic
  source 1..20: mol_type = other RNA
aaaaaattagccgggtgtgg

SEQ ID NO: 1534 - RNA, 20 nt, synthetic construct
  misc_feature 1..20: note = Synthetic
  source 1..20: mol_type = other RNA
aaattagccgggtgtggtgg

SEQ ID NO: 1535 - RNA, 20 nt, synthetic construct
  misc_feature 1..20: note = Synthetic
  source 1..20: mol_type = other RNA
aattagccgggtgtggtggc

SEQ ID NO: 1536 - RNA, 20 nt, synthetic construct
  misc_feature 1..20: note = Synthetic
  source 1..20: mol_type = other RNA
caggcgcccgccaccacacc

SEQ ID NO: 1537 - RNA, 20 nt, synthetic construct
  misc_feature 1..20: note = Synthetic
  source 1..20: mol_type = other RNA
gcctgtagtcccagctactc

SEQ ID NO: 1538 - RNA, 20 nt, synthetic construct
  misc_feature 1..20: note = Synthetic
  source 1..20: mol_type = other RNA
tgtagtcccagctactcagg

SEQ ID NO: 1539 - RNA, 20 nt, synthetic construct
  misc_feature 1..20: note = Synthetic
  source 1..20: mol_type = other RNA
tcctgagtagctgggactac

SEQ ID NO: 1540 - RNA, 20 nt, synthetic construct
  misc_feature 1..20: note = Synthetic
  source 1..20: mol_type = other RNA
cccagctactcaggaggctg

SEQ ID NO: 1541 - RNA, 20 nt, synthetic construct
  misc_feature 1..20: note = Synthetic
  source 1..20: mol_type = other RNA
cctcagcctcctgagtagct

SEQ ID NO: 1542 - RNA, 20 nt, synthetic construct
  misc_feature 1..20: note = Synthetic
  source 1..20: mol_type = other RNA
gcctcagcctcctgagtagc

SEQ ID NO: 1543 - RNA, 20 nt, synthetic construct
  misc_feature 1..20: note = Synthetic
  source 1..20: mol_type = other RNA
aggaggctgaggcaggagaa

SEQ ID NO: 1544 - RNA, 20 nt, synthetic construct
  misc_feature 1..20: note = Synthetic
  source 1..20: mol_type = other RNA
gcaggagaatggcgtgaacc

SEQ ID NO: 1545 - RNA, 20 nt, synthetic construct
  misc_feature 1..20: note = Synthetic
  source 1..20: mol_type = other RNA
caggagaatggcgtgaaccc

SEQ ID NO: 1546 - RNA, 20 nt, synthetic construct
  misc_feature 1..20: note = Synthetic
  source 1..20: mol_type = other RNA
gagaatggcgtgaacccggg

SEQ ID NO: 1547 - RNA, 20 nt, synthetic construct
  misc_feature 1..20: note = Synthetic
  source 1..20: mol_type = other RNA
aatggcgtgaacccgggagg

SEQ ID NO: 1548 - RNA, 20 nt, synthetic construct
  misc_feature 1..20: note = Synthetic
  source 1..20: mol_type = other RNA
cactgcaagctccacctccc

SEQ ID NO: 1549 - RNA, 20 nt, synthetic construct
  misc_feature 1..20: note = Synthetic
  source 1..20: mol_type = other RNA
tcactgcaagctccacctcc

SEQ ID NO: 1550 - RNA, 20 nt, synthetic construct
  misc_feature 1..20: note = Synthetic
  source 1..20: mol_type = other RNA
cataccactgcactccagcc

SEQ ID NO: 1551 - RNA, 20 nt, synthetic construct
  misc_feature 1..20: note = Synthetic
  source 1..20: mol_type = other RNA
ataccactgcactccagcct

SEQ ID NO: 1552 - RNA, 20 nt, synthetic construct
  misc_feature 1..20: note = Synthetic
  source 1..20: mol_type = other RNA
tcgcccaggctggagtgcag

SEQ ID NO: 1553 - RNA, 20 nt, synthetic construct
  misc_feature 1..20: note = Synthetic
  source 1..20: mol_type = other RNA
tctcactctttcgcccaggc

SEQ ID NO: 1554 - RNA, 20 nt, synthetic construct
  misc_feature 1..20: note = Synthetic
  source 1..20: mol_type = other RNA
ggagtctcactctttcgccc

SEQ ID NO: 1555 - RNA, 20 nt, synthetic construct
  misc_feature 1..20: note = Synthetic
  source 1..20: mol_type = other RNA
tgttttttgtttttttgaga

SEQ ID NO: 1556 - RNA, 20 nt, synthetic construct
  misc_feature 1..20: note = Synthetic
  source 1..20: mol_type = other RNA
aggaagaaagaaaggttttt

SEQ ID NO: 1557 - RNA, 20 nt, synthetic construct
  misc_feature 1..20: note = Synthetic
  source 1..20: mol_type = other RNA
agaagaaaaggaagaaagaa

SEQ ID NO: 1558 - RNA, 20 nt, synthetic construct
  misc_feature 1..20: note = Synthetic
  source 1..20: mol_type = other RNA
ctttcttccttttcttctct

SEQ ID NO: 1559 - RNA, 20 nt, synthetic construct
  misc_feature 1..20: note = Synthetic
  source 1..20: mol_type = other RNA
tttcttccttttcttctctt

SEQ ID NO: 1560 - RNA, 20 nt, synthetic construct
  misc_feature 1..20: note = Synthetic
  source 1..20: mol_type = other RNA
aatggacccaagagaagaaa

SEQ ID NO: 1561 - RNA, 20 nt, synthetic construct
  misc_feature 1..20: note = Synthetic
  source 1..20: mol_type = other RNA
ggctattacataagaaacaa

SEQ ID NO: 1562 - RNA, 20 nt, synthetic construct
  misc_feature 1..20: note = Synthetic
  source 1..20: mol_type = other RNA
cacaggaaaaggaactgtac

SEQ ID NO: 1563 - RNA, 20 nt, synthetic construct
  misc_feature 1..20: note = Synthetic
  source 1..20: mol_type = other RNA
attaaagctaacacaggaaa

SEQ ID NO: 1564 - RNA, 20 nt, synthetic construct
  misc_feature 1..20: note = Synthetic
  source 1..20: mol_type = other RNA
tcaaaaattaaagctaacac

SEQ ID NO: 1565 - RNA, 20 nt, synthetic construct
  misc_feature 1..20: note = Synthetic
  source 1..20: mol_type = other RNA
taaaattgtctaaacatctc

SEQ ID NO: 1566 - RNA, 20 nt, synthetic construct
  misc_feature 1..20: note = Synthetic
  source 1..20: mol_type = other RNA
agagatgtttagacaatttt

SEQ ID NO: 1567 - RNA, 20 nt, synthetic construct
  misc_feature 1..20: note = Synthetic
  source 1..20: mol_type = other RNA
tctaaacatctctgggacca

SEQ ID NO: 1568 - RNA, 20 nt, synthetic construct
  misc_feature 1..20: note = Synthetic
  source 1..20: mol_type = other RNA
tttatgctttcatatatcct

SEQ ID NO: 1569 - RNA, 20 nt, synthetic construct
  misc_feature 1..20: note = Synthetic
  source 1..20: mol_type = other RNA
agcataaattacaaagaaaa

SEQ ID NO: 1570 - RNA, 20 nt, synthetic construct
  misc_feature 1..20: note = Synthetic
  source 1..20: mol_type = other RNA
tacaaagaaaaaggttatca

SEQ ID NO: 1571 - RNA, 20 nt, synthetic construct
  misc_feature 1..20: note = Synthetic
  source 1..20: mol_type = other RNA
acaaagaaaaaggttatcat

SEQ ID NO: 1572 - RNA, 20 nt, synthetic construct
  misc_feature 1..20: note = Synthetic
  source 1..20: mol_type = other RNA
caaagaaaaaggttatcatg

SEQ ID NO: 1573 - RNA, 20 nt, synthetic construct
  misc_feature 1..20: note = Synthetic
  source 1..20: mol_type = other RNA
tctgagatttaaaatagagt

SEQ ID NO: 1574 - RNA, 20 nt, synthetic construct
  misc_feature 1..20: note = Synthetic
  source 1..20: mol_type = other RNA
cttataagatacattatgaa

SEQ ID NO: 1575 - RNA, 20 nt, synthetic construct
  misc_feature 1..20: note = Synthetic
  source 1..20: mol_type = other RNA
tatcttataagactataaaa

SEQ ID NO: 1576 - RNA, 20 nt, synthetic construct
  misc_feature 1..20: note = Synthetic
  source 1..20: mol_type = other RNA
atcttataagactataaaaa

SEQ ID NO: 1577 - RNA, 20 nt, synthetic construct
  misc_feature 1..20: note = Synthetic
  source 1..20: mol_type = other RNA
ttataagactataaaaaggg

SEQ ID NO: 1578 - RNA, 20 nt, synthetic construct
  misc_feature 1..20: note = Synthetic
  source 1..20: mol_type = other RNA
taaaaagggaggaaatatag

SEQ ID NO: 1579 - RNA, 20 nt, synthetic construct
  misc_feature 1..20: note = Synthetic
  source 1..20: mol_type = other RNA
aaaaagggaggaaatataga

SEQ ID NO: 1580 - RNA, 20 nt, synthetic construct
  misc_feature 1..20: note = Synthetic
  source 1..20: mol_type = other RNA
aaatatagagggtccacttt

SEQ ID NO: 1581 - RNA, 20 nt, synthetic construct
  misc_feature 1..20: note = Synthetic
  source 1..20: mol_type = other RNA
tatagagggtccacttttgg

SEQ ID NO: 1582 - RNA, 20 nt, synthetic construct
  misc_feature 1..20: note = Synthetic
  source 1..20: mol_type = other RNA
actctgaagtccaccaaaag

SEQ ID NO: 1583 - RNA, 20 nt, synthetic construct
  misc_feature 1..20: note = Synthetic
  source 1..20: mol_type = other RNA
agaatagagttgcaccgttt

SEQ ID NO: 1584 - RNA, 20 nt, synthetic construct
  misc_feature 1..20: note = Synthetic
  source 1..20: mol_type = other RNA
aaaacggtgcaactctattc

SEQ ID NO: 1585 - RNA, 20 nt, synthetic construct
  misc_feature 1..20: note = Synthetic
  source 1..20: mol_type = other RNA
ccgttttgggctaatgaaaa

SEQ ID NO: 1586 - RNA, 20 nt, synthetic construct
  misc_feature 1..20: note = Synthetic
  source 1..20: mol_type = other RNA
cctttttcattagcccaaaa

SEQ ID NO: 1587 - RNA, 20 nt, synthetic construct
  misc_feature 1..20: note = Synthetic
  source 1..20: mol_type = other RNA
tgggctaatgaaaaaggaag

SEQ ID NO: 1588 - RNA, 20 nt, synthetic construct
  misc_feature 1..20: note = Synthetic
  source 1..20: mol_type = other RNA
taatgaaaaaggaagaggct

SEQ ID NO: 1589 - RNA, 20 nt, synthetic construct
  misc_feature 1..20: note = Synthetic
  source 1..20: mol_type = other RNA
aatgaaaaaggaagaggcta

SEQ ID NO: 1590 - RNA, 20 nt, synthetic construct
  misc_feature 1..20: note = Synthetic
  source 1..20: mol_type = other RNA
ctgaatcttaaaatatgtcc

SEQ ID NO: 1591 - RNA, 20 nt, synthetic construct
  misc_feature 1..20: note = Synthetic
  source 1..20: mol_type = other RNA
caggcagctttatctcaacc

SEQ ID NO: 1592 - RNA, 20 nt, synthetic construct
  misc_feature 1..20: note = Synthetic
  source 1..20: mol_type = other RNA
ctaagagatcaagtttcagc

SEQ ID NO: 1593 - RNA, 20 nt, synthetic construct
  misc_feature 1..20: note = Synthetic
  source 1..20: mol_type = other RNA
gtgttcttgttgatattctg

SEQ ID NO: 1594 - RNA, 20 nt, synthetic construct
  misc_feature 1..20: note = Synthetic
  source 1..20: mol_type = other RNA
cttgttgatattctgtggca

SEQ ID NO: 1595 - RNA, 20 nt, synthetic construct
  misc_feature 1..20: note = Synthetic
  source 1..20: mol_type = other RNA
tctgtggcatggctacagat

SEQ ID NO: 1596 - RNA, 20 nt, synthetic construct
  misc_feature 1..20: note = Synthetic
  source 1..20: mol_type = other RNA
agaacttatttacacaggga

SEQ ID NO: 1597 - RNA, 20 nt, synthetic construct
  misc_feature 1..20: note = Synthetic
  source 1..20: mol_type = other RNA
aaagagaacttatttacaca

SEQ ID NO: 1598 - RNA, 20 nt, synthetic construct
  misc_feature 1..20: note = Synthetic
  source 1..20: mol_type = other RNA
caaagagaacttatttacac

SEQ ID NO: 1599 - RNA, 20 nt, synthetic construct
  misc_feature 1..20: note = Synthetic
  source 1..20: mol_type = other RNA
ttctctttgtatttactttt

SEQ ID NO: 1600 - RNA, 20 nt, synthetic construct
  misc_feature 1..20: note = Synthetic
  source 1..20: mol_type = other RNA
tctctttgtatttactttta

SEQ ID NO: 1601 - RNA, 20 nt, synthetic construct
  misc_feature 1..20: note = Synthetic
  source 1..20: mol_type = other RNA
ctttgtatttacttttaggg

SEQ ID NO: 1602 - RNA, 20 nt, synthetic construct
  misc_feature 1..20: note = Synthetic
  source 1..20: mol_type = other RNA
agcttttgtccacctttaaa

SEQ ID NO: 1603 - RNA, 20 nt, synthetic construct
  misc_feature 1..20: note = Synthetic
  source 1..20: mol_type = other RNA
tttatttttccatttaaagg

SEQ ID NO: 1604 - RNA, 20 nt, synthetic construct
  misc_feature 1..20: note = Synthetic
  source 1..20: mol_type = other RNA
tattttatttttccatttaa

SEQ ID NO: 1605 - RNA, 20 nt, synthetic construct
  misc_feature 1..20: note = Synthetic
  source 1..20: mol_type = other RNA
cttacataaacatacttaaa

SEQ ID NO: 1606 - RNA, 20 nt, synthetic construct
  misc_feature 1..20: note = Synthetic
  source 1..20: mol_type = other RNA
taagcacagaagtttttaag

SEQ ID NO: 1607 - RNA, 20 nt, synthetic construct
  misc_feature 1..20: note = Synthetic
  source 1..20: mol_type = other RNA
aagtttttaagaggcatgaa

SEQ ID NO: 1608 - RNA, 20 nt, synthetic construct
  misc_feature 1..20: note = Synthetic
  source 1..20: mol_type = other RNA
atatttacgtagtttttcat

SEQ ID NO: 1609 - RNA, 20 nt, synthetic construct
  misc_feature 1..20: note = Synthetic
  source 1..20: mol_type = other RNA
cgtaaatattcttgagaaac

SEQ ID NO: 1610 - RNA, 20 nt, synthetic construct
  misc_feature 1..20: note = Synthetic
  source 1..20: mol_type = other RNA
ttcttgagaaacaggaagac

SEQ ID NO: 1611 - RNA, 20 nt, synthetic construct
  misc_feature 1..20: note = Synthetic
  source 1..20: mol_type = other RNA
taatattaaaaacattggtt

SEQ ID NO: 1612 - RNA, 20 nt, synthetic construct
  misc_feature 1..20: note = Synthetic
  source 1..20: mol_type = other RNA
ccaatgtttttaatattatc

SEQ ID NO: 1613 - RNA, 20 nt, synthetic construct
  misc_feature 1..20: note = Synthetic
  source 1..20: mol_type = other RNA
cctgataatattaaaaacat

SEQ ID NO: 1614 - RNA, 20 nt, synthetic construct
  misc_feature 1..20: note = Synthetic
  source 1..20: mol_type = other RNA
cattatcatgcatacatctc

SEQ ID NO: 1615 - RNA, 20 nt, synthetic construct
  misc_feature 1..20: note = Synthetic
  source 1..20: mol_type = other RNA
atcatgcatacatctctggc

SEQ ID NO: 1616 - RNA, 20 nt, synthetic construct
  misc_feature 1..20: note = Synthetic
  source 1..20: mol_type = other RNA
ttcatttcattttgattttg

SEQ ID NO: 1617 - RNA, 20 nt, synthetic construct
  misc_feature 1..20: note = Synthetic
  source 1..20: mol_type = other RNA
attcaatttgaagcagtggt

SEQ ID NO: 1618 - RNA, 20 nt, synthetic construct
  misc_feature 1..20: note = Synthetic
  source 1..20: mol_type = other RNA
gaatattcaatttgaagcag

SEQ ID NO: 1619 - RNA, 20 nt, synthetic construct
  misc_feature 1..20: note = Synthetic
  source 1..20: mol_type = other RNA
catacgatttaaaatcgctg

SEQ ID NO: 1620 - RNA, 20 nt, synthetic construct
  misc_feature 1..20: note = Synthetic
  source 1..20: mol_type = other RNA
aaaatcgctgaggcgcgttc

SEQ ID NO: 1621 - RNA, 20 nt, synthetic construct
  misc_feature 1..20: note = Synthetic
  source 1..20: mol_type = other RNA
tttttttttcttttttgtac

SEQ ID NO: 1622 - RNA, 20 nt, synthetic construct
  misc_feature 1..20: note = Synthetic
  source 1..20: mol_type = other RNA
ctgttgtcaaagattttaaa

SEQ ID NO: 1623 - RNA, 20 nt, synthetic construct
  misc_feature 1..20: note = Synthetic
  source 1..20: mol_type = other RNA
tgacaacagagttctgtttt

SEQ ID NO: 1624 - RNA, 20 nt, synthetic construct
  misc_feature 1..20: note = Synthetic
  source 1..20: mol_type = other RNA
agaatacgctgagagttatc

SEQ ID NO: 1625 - RNA, 20 nt, synthetic construct
  misc_feature 1..20: note = Synthetic
  source 1..20: mol_type = other RNA
gcaagagaagaaaagaacgg

SEQ ID NO: 1626 - RNA, 20 nt, synthetic construct
  misc_feature 1..20: note = Synthetic
  source 1..20: mol_type = other RNA
gttgcaagagaagaaaagaa

SEQ ID NO: 1627 - RNA, 20 nt, synthetic construct
  misc_feature 1..20: note = Synthetic
  source 1..20: mol_type = other RNA
atgcacacgtaaaagagagg

SEQ ID NO: 1628 - RNA, 20 nt, synthetic construct
  misc_feature 1..20: note = Synthetic
  source 1..20: mol_type = other RNA
aagatgcacacgtaaaagag

SEQ ID NO: 1629 - RNA, 20 nt, synthetic construct
  misc_feature 1..20: note = Synthetic
  source 1..20: mol_type = other RNA
atcatgcatacatctctggc

SEQ ID NO: 1630 - RNA, 20 nt, synthetic construct
  misc_feature 1..20: note = Synthetic
  source 1..20: mol_type = other RNA
ttcatttcattttgattttg

SEQ ID NO: 1631 - RNA, 20 nt, synthetic construct
  misc_feature 1..20: note = Synthetic
  source 1..20: mol_type = other RNA
attcaatttgaagcagtggt

SEQ ID NO: 1632 - RNA, 20 nt, synthetic construct
  misc_feature 1..20: note = Synthetic
  source 1..20: mol_type = other RNA
gaatattcaatttgaagcag

SEQ ID NO: 1633 - RNA, 20 nt, synthetic construct
  misc_feature 1..20: note = Synthetic
  source 1..20: mol_type = other RNA
catacgatttaaaatcgctg

SEQ ID NO: 1634 - RNA, 20 nt, synthetic construct
  misc_feature 1..20: note = Synthetic
  source 1..20: mol_type = other RNA
aaaatcgctgaggcgcgttc

SEQ ID NO: 1635 - RNA, 20 nt, synthetic construct
  misc_feature 1..20: note = Synthetic
  source 1..20: mol_type = other RNA
tttttttttcttttttgtac

SEQ ID NO: 1636 - RNA, 20 nt, synthetic construct
  misc_feature 1..20: note = Synthetic
  source 1..20: mol_type = other RNA
ctgttgtcaaagattttaaa

SEQ ID NO: 1637 - RNA, 20 nt, synthetic construct
  misc_feature 1..20: note = Synthetic
  source 1..20: mol_type = other RNA
tgacaacagagttctgtttt

SEQ ID NO: 1638 - RNA, 20 nt, synthetic construct
  misc_feature 1..20: note = Synthetic
  source 1..20: mol_type = other RNA
agaatacgctgagagttatc

SEQ ID NO: 1639 - RNA, 20 nt, synthetic construct
  misc_feature 1..20: note = Synthetic
  source 1..20: mol_type = other RNA
gcaagagaagaaaagaacgg

SEQ ID NO: 1640 - RNA, 20 nt, synthetic construct
  misc_feature 1..20: note = Synthetic
  source 1..20: mol_type = other RNA
gttgcaagagaagaaaagaa

SEQ ID NO: 1641 - RNA, 20 nt, synthetic construct
  misc_feature 1..20: note = Synthetic
  source 1..20: mol_type = other RNA
atgcacacgtaaaagagagg

SEQ ID NO: 1642 - RNA, 20 nt, synthetic construct
  misc_feature 1..20: note = Synthetic
  source 1..20: mol_type = other RNA
aagatgcacacgtaaaagag

SEQ ID NO: 1643 - RNA, 20 nt, synthetic construct
  misc_feature 1..20: note = Synthetic
  source 1..20: mol_type = other RNA
ggcagaccgttctcatcacg

SEQ ID NO: 1644 - RNA, 20 nt, synthetic construct
  misc_feature 1..20: note = Synthetic
  source 1..20: mol_type = other RNA
ctttaccagtgactccaggt

SEQ ID NO: 1645 - RNA, 20 nt, synthetic construct
  misc_feature 1..20: note = Synthetic
  source 1..20: mol_type = other RNA
gtcacagatttccttctccg

SEQ ID NO: 1646 - RNA, 20 nt, synthetic construct
  misc_feature 1..20: note = Synthetic
  source 1..20: mol_type = other RNA
agatgatgacgcccaccaga

SEQ ID NO: 1647 - RNA, 20 nt, synthetic construct
  misc_feature 1..20: note = Synthetic
  source 1..20: mol_type = other RNA
ggagaaggaaatctgtgacc

SEQ ID NO: 1648 - RNA, 20 nt, synthetic construct
  misc_feature 1..20: note = Synthetic
  source 1..20: mol_type = other RNA
tgcgaggaacttacttttcc

SEQ ID NO: 1649 - RNA, 20 nt, synthetic construct
  misc_feature 1..20: note = Synthetic
  source 1..20: mol_type = other RNA
agagaaatattgatatagga

SEQ ID NO: 1650 - RNA, 20 nt, synthetic construct
  misc_feature 1..20: note = Synthetic
  source 1..20: mol_type = other RNA
tatcaatatttctctgatcc

SEQ ID NO: 1651 - RNA, 20 nt, synthetic construct
  misc_feature 1..20: note = Synthetic
  source 1..20: mol_type = other RNA
atcgcttttaaggcacgctc

SEQ ID NO: 1652 - RNA, 20 nt, synthetic construct
  misc_feature 1..20: note = Synthetic
  source 1..20: mol_type = other RNA
tatacgactgatcgctttta

We claim:

1. A method of modifying an HSD17B13 gene in a hepatocytes in a human subject, comprising introducing into the hepatocytes:

(a) a Cas9 protein or a nucleic acid encoding the Cas9 protein; and (b) a guide RNA or a DNA encoding the guide RNA, wherein the guide RNA comprises a CRISPR RNA (crRNA) portion and a trans-activating CRISPR RNA (tracrRNA) portion, wherein the guide RNA forms a complex with the Cas9 protein and targets a guide RNA target sequence within a coding region the HSD17B13 gene, wherein the human subject has or is susceptible to developing non-alcoholic steatohepatitis (NASH), and wherein the Cas9 protein cleaves the guide RNA target sequence in the hepatocytes to generate a loss of function modification in the coding region of the HSD17B13 gene in the hepatocytes, and thereby having a therapeutic or prophylactic effect against the NASH in the human subject.

2. The method of claim 1, wherein:

(a) the guide RNA target sequence comprises any one of SEQ ID NOS: 20 239; and/or (b) the guide RNA comprises a DNA-targeting segment comprising any one of SEQ ID NOS: 1423-1642; and/or (c) the guide RNA comprises any one of SEQ ID NOS: 500-719, 730-949, 960-1179, and 1190-1409.

3. The method of claim 1, further comprising introducing into the liver cell-hepatocytes one or more additional guide RNAs or one or more DNAs encoding the one or more additional guide RNAs, wherein each of the one or more additional guide RNAs forms a complex with the Cas9 protein and targets an additional guide RNA target sequence within the HSD17B13 gene.

4. The method of claim 1, wherein the loss of function modification is generated by repair of the cleaved guide RNA target sequence by non-homologous end joining.

5. The method of claim 1, wherein the method comprises introducing into the hepatocytes the nucleic acid encoding the Cas9 protein.

6. The method of claim 5, wherein the nucleic acid encoding the Cas9 protein comprises DNA.

7. The method of claim 5, wherein the nucleic acid encoding the Cas9 protein comprises RNA.

8. The method of claim 1, wherein the method comprises introducing into the hepatocytes the guide RNA in the form of RNA.

9. The method of claim 1, wherein the method comprises introducing into the hepatocytes the DNA encoding the guide RNA.

10. The method of claim 1, wherein the Cas9 protein or the nucleic acid encoding the Cas9 protein and/or the guide RNA or the DNA encoding the guide RNA are introduced into the hepatocytes via lipid-nanoparticle-mediated delivery.

11. The method of claim 1, wherein the Cas9 protein or the nucleic acid encoding the Cas9 protein and/or the guide RNA or the DNA encoding the guide RNA are introduced into the hepatocytes via adeno-associated virus.

12. The method of claim 1, wherein the guide RNA is a single-molecule guide RNA in which the crRNA portion is linked to the tracrRNA portion.

13. The method of claim 12, wherein the guide RNA comprises the sequence set forth in SEQ ID NO: 1420, 256, 257, or 258.

14. The method of claim 1, wherein the crRNA portion and the tracrRNA portion are separate RNA molecules.

15. The method of claim 14, wherein the crRNA portion comprises the sequence set forth in SEQ ID NO: 1421 and/or the tracrRNA portion comprises the sequence set forth in SEQ ID NO: 1422.

16. The method of claim 1, wherein the guide RNA comprises a modification providing for modified or regulated stability.

17. The method of claim 1, wherein the human subject is not a carrier of the HSD17B13 rs72613567 variant.

18. The method of claim 1, wherein the Cas9 protein is a nickase and cleavage creates a single-strand break.

19. The method of claim 18, wherein the nickase is fused to a heterologous polypeptide.

20. The method of claim 1, wherein Cas9 protein cleavage creates a double-strand break.

* * * * *